United States Patent 7,745,391 (HUMAN THROMBOSPONDIN POLYPEPTIDE) - sequence listing, part 298

SEQ ID NO: 1023323 - protein, 205 aa, Homo sapiens
MGIYVGAKVFLIYEGYEGLVEGGENIKQANWLRVSNIIQTGADTSHLAALRMQGLYHQGRGAGQRPYNLVQHGKSPNCDVTRRGMAASQVPTSCRKRVEQHDWRSLVAERVRSQETTRPEPTRDLNIAETRWASNRYTDFCGNDMTNGTDLGPPPHSWRVINAITTTAPEPTEDLRAEEDDGPDTDGYLDSMVSSKDTKADWMPT

SEQ ID NO: 1023324 - protein, 83 aa, Homo sapiens
PLTEDTLRLLEKIAPSTLTYEHSCVNCPLAHNAKQDTEQGAAEVNELQYGDAFDAADQSWREQKATRPRILAAGDINAREMAF

SEQ ID NO: 1023325 - protein, 33 aa, Homo sapiens
MPKDDLGRGTETGTLDEKETTVRGLEYPETANF

SEQ ID NO: 1023326 - protein, 42 aa, Homo sapiens
GSRKAEIEAGDVTFPMHGMMCCNEPRSVPLHSMPGNMSETLS

SEQ ID NO: 1023327 - protein, 69 aa, Homo sapiens
GPELMLKGVEPKPGEYDDAYLASITRTVRTLRAHGIMTLLDAHQDMYNEKFEGEGAPDWAVLNKGYRAP

SEQ ID NO: 1023328 - protein, 38 aa, Homo sapiens
PADPAGHTVPSRSVRHLPREALHESQPGCDCALSGYSG

SEQ ID NO: 1023329 - protein, 51 aa, Homo sapiens
DSEWNLMDSGMERESNEEEWSFVEWNVWNRIEWNGKQWNGIEWNEEVKYEL

SEQ ID NO: 1023330 - protein, 67 aa, Homo sapiens
SSTPGILFQQEIPGAEALHYHKHLQTQSPLPLPGPTFSVSYLCPGMLPWTMKDPAALCYTWLGLLRY

SEQ ID NO: 1023331 - protein, 292 aa, Homo sapiens
HGAGTVATVDVAGQAHEGTTGVWTPVRREQAREGRHKVGATIVLDGVSESFDLRGGLEYLEVVAQPLYQRSSDGNRTFQGIDGGLVTDLVADGGQQTVLGEDGLLTCVHEHEAAGAVRVLRHALLEASLAKSGGLLIAKNAGDRGIDQQAVLATIAVDLGGGLDLRKHGLRNPHDLAHRVVPLQLSDVHEHGSGRVGRIGDVHATVNTAKSGSTSTQVFNVNRKQQIAGSGLAKAPPRCENPLTSARESVTADPHLWRGGPGNSQSSELDRVAPSVHARVGHTVRWIQQAGR

SEQ ID NO: 1023332 - protein, 33 aa, Homo sapiens
MGIVAVWHSDQIRAPIPRKCPSPVLHMSSPVLH

SEQ ID NO: 1023333 - protein, 127 aa, Homo sapiens
MRHQRTDHTLLDRLSNALEHEAKMPVIVSENTMESLLVDIVADLRPGFDDVDAEEFGTSLQGETELDGYLTFRDVLHRMVHRLTYYVETNRYGEATKVPVTSKEFMDVVSTVDGLINDFPDLPVSSL

SEQ ID NO: 1023334 - protein, 242 aa, Homo sapiens
SGAVAVSGSFANDCRRNNEDVIITALRGLGWGAADAGSSACAPRWGWAGLGWAGLELDRLSPPGPPSARGVCGARGFGAGWTWEPGEGPGGEIAGRGGRRREGGAPGQRRFAGGERTRGRGCAAGLRCASETRGPRSRPCALGARVLPAPARPPPPPPPVNGDPGHGLDLEIRDLSAGPGSSIDYRSKRSSSEFILRVDELGQPGLWGVGNCKYSPKRRRFSRLPGPRGLDGSSGDGNGGYP

SEQ ID NO: 1023335 - protein, 85 aa, Homo sapiens
PDSPTVVGSRTPCILCEELFKLLNGGHRYDSSPLNCTHDLYMIMRECWHAAPSQRPILQAAGGGPGPCPYRDVHRRVPGPVGLVG

SEQ ID NO: 1023336 - protein, 134 aa, Homo sapiens
LDLGKRPTKDSYTLTEEAEYAEIRVKVKELGAACVADPPHGPSSGPPLAVGSLPTQKYSGAGAGRGVMVMVISEGLGAHDLLLSSLTVTFVPAPPTPSLRLLSNLLYPHLSGGELCLSVLFIATSCIISWPHTW

SEQ ID NO: 1023337 - protein, 218 aa, Homo sapiens
EESAATGHYLVRDVTPVCPKASQSESCAAAGCSGVRVSGVRKDLSSSRGSSVPFPCPQSSELEPTDMQGTGMAKSRGDSGIDLGHAPTPCVGVFQHGKGGDHRQRPGGTVTTPSYVAFTDTERLIGDAAKNQVALNPQNTVCDAKRLIGRKFGDPVVQSDMKHWPFQVINDGDKPKVQVSYKGETKAFYPRGDLVHGADQDEGGRIAVPGYPGSPIRS

SEQ ID NO: 1023338 - protein, 179 aa, Homo sapiens
GPQARETWRALKLSLALSFSGAIGLTFLMLGCALEDYGVYLALYTSMIFHAISPPIPHFIAKGVTYDSDATSQMPVGNWNISSLYVRICVFSAYVDFPVIRCVVLAVIKLGSLRALVYGRQMQVIFLTIQGYVPLVFGRGDDFSWETVVALYSDYSGIEFLRTHTICIHVHMRHCYYGN

SEQ ID NO: 1023339 - protein, 69 aa, Homo sapiens
DKLYKKHAVPVRIPGSRPSSALLGPRAPQWPLSGDEDISSIADMDFSALLSQISSYRGRLPSPENWVAD

SEQ ID NO: 1023340 - protein, 106 aa, Homo sapiens
MTCHCCSWFSPVLPLRLTHLDDSETCQRPWTPRPKFPEPGPDDSCNVTLFMVPLPHFHLCHITNSWGGVPQTTGTNLNFARLLNFLAIFIICMALICTRAEPAEVS

SEQ ID NO: 1023341 - protein, 127 aa, Homo sapiens
VCGDSRGCQCYSTNRFEGNLFTEKRTDGGSSSSLMAAPWRGIMWMLPCRARGVYYSTTDWGEFSGTCRRMMLTVQPEYAHTMGRLDSSRGTYNREHSVMASVLDILPMEVALLFVGGSTGVPELDIR

SEQ ID NO: 1023342 - protein, 228 aa, Homo sapiens
MDPNCSCATGKVKLCALESPFPSPITEGLWVSGSRILSSERRGLQYFVRCFLPDHAPESIALIPGPLQSELRILRLKAELLHITQLVMGLLAGPQCSVQALSISVVGGAGNIDSSEFRTEGSGSQSQYSWVVCARGTFLVRYNRRVLALPSVSGEDMGLLFLCPEWERSSEGWACTEEGARGDSLTHCCTFCISLTAHCVFLFLVGGSCTCAGSCKCKECQMHLLQEE

SEQ ID NO: 1023343 - protein, 122 aa, Homo sapiens
MDPNCSCATGGSCTCAGSCKCKRVQDAAFLHRKELLLAMTCPPVVLCQGVPTGHDDHARRGRSRERCKTAGALTGGKHGCLLRKNGKSNTSRAYNALAIYVLYGHSIRHLSATLGVAFFSCY

SEQ ID NO: 1023344 - protein, 48 aa, Homo sapiens
HHTISMTLTITVITTIITITFSTIVTIIMTNTIDTTTTITNTVSPTRS

SEQ ID NO: 1023345 - protein, 378 aa, Homo sapiens
PGVSILVSGVDSARTSARGKRSYSYPGRGAGSLHYHPTPYLFHPDARRSRSASWQGTGGYMISTSRQAPATSPCSAGRDIVMHIYDHMEKMDDTTDYMRTLRMSDDQTGDPKGLRSSEPRCQHGWNNRYKTCMSIRYMQYKDGIQKASIDEQPSHGGRADMLLKWCVDIMRINRQRWPDIVHLTLGTELSSDARHTMGVTFHQDQYKKPVRTLRVPELAVMDINQQPYPMTPVANTSSLLRQSPQPGGRSTDIGNTQTARGLEPQITRNYPHKDKPTNNTGTDKGITLSSDTTMERTDKERNEGEETAFSHPPKLGGQQERHDLAKDREAGNAAVRDTCDLPHENAPRRTRLSVPGPSGDPSIAYTGGPEDPPRRARE

SEQ ID NO: 1023346 - protein, 125 aa, Homo sapiens
PGRLHFGLRCGLGKNQRKREAEIIATPAAEPAHCTFEEVGNGGGGNVGGKEGLGSGEKRLMRGVGGNDKKELGWKNKYVYEYKDGRKVKVERMINVEYGKKVEELLKLDDYDEEKGELKKEIKEK

SEQ ID NO: 1023347 - protein, 36 aa, Homo sapiens
VQAGSGVAVTPITSNSCASCRGSFGWLHHCVMVTVA

SEQ ID NO: 1023348 - protein, 36 aa, Homo sapiens
MAVHMMLHAPHNGAQLNWEREVARKGTDERMEAEER

SEQ ID NO: 1023349 - protein, 62 aa, Homo sapiens
MSLPVTSPFLAPLLLALTRNLSGSDPRRVLGLGRQCAPLLCLVHGSVKQPVSEPSRSWFAPH

SEQ ID NO: 1023350 - protein, 132 aa, Homo sapiens
CVRDKPHFPNLYYAVNFLSPFLPTTIHSPKGRVTLLKTKLMSLLRLGSEKLTITQSPEHTIQVLYSSSCGPSQPPAHHSHSLFCQRTIPSTDLSEHTMLCPTSTPSTLHLEHSPPLPFLPLPYLYTRDPHRV

SEQ ID NO: 1023351 - protein, 39 aa, Homo sapiens
TRGSRHGLRRRCSVAVFHQSIRSPRQSRAPPPFLSLELG

SEQ ID NO: 1023352 - protein, 115 aa, Homo sapiens
GSSDSNMRTANIAAGSSSGSFVSEGHLAIWGVSLPLLGGASQLGYLAVRDPLEEAVCLFSDLKLHAGRTTTLFKAVRQGHLSLQLALSFFLSFFLSFFLSFFLSFFLFLSLLVPL

SEQ ID NO: 1023353 - protein, 46 aa, Homo sapiens
MGQGTTASQGVTWATFFTGCRVSQGSPFCHLVMITGNGWDSVRPTR

SEQ ID NO: 1023354 - protein, 96 aa, Homo sapiens
MCFCVEAMKAEGLAPEKPSSSRPHHFTKEKGLPPPSPTCNVRSHTAVHETGISSRYPSRGAAEGLEASYELLDWGHPLRLVPYPYTYTDLTTEDIL

SEQ ID NO: 1023355 - protein, 44 aa, Homo sapiens
IELVPGGESESATDNSSNTAAAADNSIIMRGTALNHSAYVIPYS

SEQ ID NO: 1023356 - protein, 104 aa, Homo sapiens
HRMKRRRKAQTKGYLLPKRSFKIHLYSEHLLSTYNVLNTLRYKDWLSLSFLSFFLPFFFLFLPSFFPSFFLFLSSFLLSLSFERKRKKEGRKERKGEKERERRK

SEQ ID NO: 1023357 - protein, 101 aa, Homo sapiens
RRRVYQITLFEDSRHSRTPDDTDATKSVLSRVLTATERLQDDTLFTHVSLLLLLIVNPYKRLTIIMTRSWLIVVSGCLGPRPKCLCPSTDFGHQKEILQHL

SEQ ID NO: 1023358 - protein, 98 aa, Homo sapiens
MNYAKSLPEWALSPSTPLLRTVRYPNPPHPDALAVRTMGCIRVDKITEFLCEPLRKCLNDEGPYLRKTAAVCVANLHDFNAQLVEDQDFLDTLIDLIS

SEQ ID NO: 1023359 - protein, 272 aa, Homo sapiens
ERRGPCPRGLHDVRSERPPAVCRRRLLLPVRLWLSAAVPCAPLVAGPGLLHPCPLWPVPWHGKGWQAVLECMPLVPTGRAPDAPGSLTGDPALYPCTDVGAASKAEKCPAVEAERCQSYRLTVAFLQGERKSGRKNLKERTLCAGRIKMLEYALKQERAKYHKLKYGTDLNQGEKKADVSEQVSNGPVDSVTLENSPLAVRRRGGSFSAQYLDERSMTRMAYSHLPKEYLDKTVGYTRHHPSTMRTNAASVPAGPLAGAYNGAREADVKGAP

SEQ ID NO: 1023360 - protein, 69 aa, Homo sapiens
QEVSQSRARFNPSISMIKKCIEVLDKQNIERQAPADENSARCRPPPAWCEKIIAITIWCVPGKSRTVPP

SEQ ID NO: 1023361 - protein, 76 aa, Homo sapiens
MYFSSKIREGTSYDLLSAIMAGKVRETFLHMVSLQMVSMPRNHVLGKCVLNPITMLYTHYLNGLQPMDSFVLVLWK

SEQ ID NO: 1023362 - protein, 122 aa, Homo sapiens
TIRMPSLSRRCLVPRLRCWSLEQHWEGLPFLALKRHLLKRVLLSLLLVCSLLGSHVQIPNLGLEALGFEVLLGSPSLPLCHSLPMWPLQQPDLLTVRSSLHGAFGIRCLPCLSPPPGLQTQF

SEQ ID NO: 1023363 - protein, 323 aa, Homo sapiens
IKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPEPTDTAPGEQAQDVASSPPESSFQRLATSEYRV

SEQ ID NO: 1023364 - protein, 91 aa, Homo sapiens
MPMHRRLDFDQNRRARREVTHRSDVLTPRNRRNDLGIIQQAGGYFVARAPRIKDDDIFVPAVLTDRRHLLGYPDGKNVDSYSLGLLNQQLM

SEQ ID NO: 1023365 - protein, 275 aa, Homo sapiens
MASRRMETKPVITCLKTLLIIYSFVFWITGVILLAVGVWGKLTLGPPISPLLPRTPQNAPYVLIGTGTTIVVFGLLWMLCLHVVVDPWYAETVCHVSVPGCSWLSSYLAIVRGLVYRHGDQGTTFLRTYTDAMQTYNGNDEREPGELDQCAGARLKPAVVCRTVTNLEQQPTYFLGAWHLPPSLLHELKADCNPQDLQESDCGPPPKLIQKRLALIWVTKFHGRLTWDIICCEWRVWNPHSSQLIWNAAGLLSVPRFTHGPIKYEMALRKKICQQ

SEQ ID NO: 1023366 - protein, 156 aa, Homo sapiens
AEYGIEENGDQTCDNLSNHHISRYGAADRHPAFLCELTMLYCAIDCTLMCLAVMLLLSVLMLTVCSLSVSGDSYCSVVAEIDTFLNYTDAMQTYKHDERSRRDLCRTELVVCKLPTEHAYLTAPHLMTMMYPINRVPQVQVYTYYLNTGSLMVIIS

SEQ ID NO: 1023367 - protein, 79 aa, Homo sapiens
SIRSRVLCIRHSPVRVSPLIIPSTYVRDRRSRGWRRRAGAATDRPHASPCMRHHPPDRPRTYYCYISLQQQKIPSIFKK

SEQ ID NO: 1023368 - protein, 99 aa, Homo sapiens
AHSFSTSACSFPHRMYTMCHLPLPICAWLLTSLSYQLWPLERKQVCLIQHCTVRSKTGTGHGWSSKRMKQRLRLSFPKYYPTSPKRERGKHVVINGKGK

SEQ ID NO: 1023369 - protein, 191 aa, Homo sapiens
VYVPTTRVPSMLPSLPYLPSSGSSQQASPVSSHSIWTQPGAESAAYNPGSSHPPVSPRFSFSTSTPIPSTSSRDAAAAYSSSLSLSANGREQYSRGFGSSYSSPYPVYVSPEIGTTWTSSPFDSPMLHNLQSKGTPAAARHANIEFLDDYSEGRECVNCGACHPVWRRRWTGTTSECCGSIKDEGITVLSN

SEQ ID NO: 1023370 - protein, 146 aa, Homo sapiens
SDTAIRSGLELLKVLSFTHPTSFHSAETYESLLQCLRMEDDKVAEAAIQIFRNTGHKIETDLPQIRSTLIAHLYIKKQRGVLHDQVKTGCALYTRHIHQIREVQLAQIFEPLSRSLNADVPEQLITPLVSLGHIFYVSTRSVCFPK

SEQ ID NO: 1023371 - protein, 39 aa, Homo sapiens
GPRYHRHRGWCKIGVVEVEVNEGDGGMMVPMNGEVPMNS

SEQ ID NO: 1023372 - protein, 171 aa, Homo sapiens
MPRPSVVLPCGELACGIGRNWEAARVGPGEALWLLTLWFLRTWGAQDFLINRKDVFGVGASGEKFAGKERTRGMASGDHPSWNSEERRSGPSGSLGQKPSNPLDQRTACVGEKEAPVDLRETRVSDLSKELPRACERWGEDEIGSLAHRAPLGAESVQTRTGGTNGLPRQG

SEQ ID NO: 1023373 - protein, 210 aa, Homo sapiens
MCQSSLASKDLQNVNITLRHPLPDLYARPDITYVIIPPGIGEDYDERVLSVHLQTEILKDSGGYTLSAGELIHPERAGLQDMVKRQNFTELSRPTIGGSIPGMTVSVETIVTLSGKEFTKKTVEAKQEAQQDRPDEGQIRGGQRAEQRKKAAIISAERRLLRQTELIANSSGPLQGDGLIESAQAGSMRRTSCTRLSTLSEHRPILLSRG

SEQ ID NO: 1023374 - protein, 162 aa, Homo sapiens
VRNSYVLLFKNNDGVCYVAQTRVQWLVTGTIIRVHPLTPGLKLFSYLNFVSSGTTGTHHCAQLALLFVLCPTTSWTPKTTLMSYAHKFAIFLNFFFFLEMEVLVAQAGVQGCDYSSLQPRAFQVKVILLSHSASQIAGTTVSCNYNGLWNFFSRDGFWPCRP

SEQ ID NO: 1023375 - protein, 33 aa, Homo sapiens
MHEWRPHMPRRMLDHARLEESASPPTSREDLPP

SEQ ID NO: 1023376 - protein, 176 aa, Homo sapiens
MSRVGEEVHQIRIKIISAAIRAFGREKTGNSAKFGRPGIGPASIGPVMVQSFTLSFQESTRLNDPGGKDPEVTTGDLLGLQLAKFGDLQRIYSCKIPGGRDEQKSGNYLICFETHDGFASKRKGSGKLGSPQRRTECGSLTVGESAMGEYSCQGTRDTGGPSFVRTVHNYFETTNF

SEQ ID NO: 1023377 - protein, 61 aa, Homo sapiens
FSAAAPRQPVLMAQMATTAAGVAVCSAVGHTLCHAITGVFSGGSNAEPAMPDITYHEPQGT

SEQ ID NO: 1023378 - protein, 292 aa, Homo sapiens
LAFAAHSAAMEQRRVTDFFARRRPGPPRIAPPKLACRTPSPARPALRAPGLRIPGGSRKRARPPAAPGRDQARPPAAGDCGRRGTRVLSPRIPEAPDIPAFPPGKKKKKTTPAAGQPPHLTSAQDQDTISELVSCQQRARELGARDRALKARAQDAGETCTPEAEGGPEEPSGEKAPAYRFHVLVQLGLPGLVLPYKYQVLAEMFRSMDTIVGMLHNRSETPTFAKVQRGVQDMMRRRFEERNVGQIKTVYPASYRFRSAVSPPSRMAQEADYQLTIEPLLEQEADGAAPQL

SEQ ID NO: 1023379 - protein, 82 aa, Homo sapiens
MRGTLMDGSVRQVVLVKDCVVPRCTVLFQVSAPKPSGSQRLPGTASPGIHQCPRSAEEGWAKYLQIAKGLLKGLGKSRRSRY

SEQ ID NO: 1023380 - protein, 116 aa, Homo sapiens
MLEFYGVGISYLLLCNKFSSLKQQTLSHSFCGSEFCAVYLGLTGLVSHQAVKVLMAAVIIPRQDRERICLQAHIGRNHLRGCWTGPPFLDGYWSEAFYNTLSRGPLHRAPHHMATQ

SEQ ID NO: 1023381 - protein, 59 aa, Homo sapiens
MMISNFIHVLGYPIGFFIQSYTYPSGSFIQSYTYPSGFFIQSYTYPSGSFIQSYTGTEL

SEQ ID NO: 1023382 - protein, 130 aa, Homo sapiens
WGLGWGRGNSPLGVDVDPQSQGGKLVAQLAGGKAQVTSGRQVLLVGGPRVYLHGVLVSGTGLEGGQLQGSGRGWAGRIQEFIFNKRVTAEAPGDGHNVRIPQTDSRGLAEKAHLCTEARVGGGGGAGSPR

SEQ ID NO: 1023383 - protein, 34 aa, Homo sapiens
MYGPRFVHRGIVTLEQEKAFPQLVRRGDPLDHPA

SEQ ID NO: 1023384 - protein, 34 aa, Homo sapiens
MRVVGDDYEPYDRPYQWRDSFHEEYRPPTEMVEE

SEQ ID NO: 1023385 - protein, 136 aa, Homo sapiens
HPCLYIVLLSCDMTARQEEEQWWGLLEVEVLQEGEAEAEVNVVSTKEVLMKYEGVFGRGGGRELHRSQSWEERGDRRFEKPGRKDVGRPNLEEGGPTSVGRKHDFIRSERANWRIFREEQTGADDAGGWRLAESSQ

SEQ ID NO: 1023386 - protein, 109 aa, Homo sapiens
MEKIWHHTFYNELRVAPEEHPVLLTEAPLNPKANREKMTQIMFETFNTPAMYVAIQAVLSLYASGRTTGIVMDSGDGSPKLCPSTRGMPSPMPSCVWTLVGRDLELTTS

SEQ ID NO: 1023387 - protein, 248 aa, Homo sapiens
DAWVDPRVRALRLLKLAATSASARVVAAGAQRVRGIHSSVQCKLRYGMWHFLLGDKASKRLTERSRVITVDGNICTGKGKLAKEISEKLGFKHFPEAGIHYPDTTGRWGRPLGHRTIMVQLVVWEKFYGWIRRSNGWATGYRPVQVLWFVQAVRPGWQLLQDGLGEALWLDAPGTKGGWWLGSGSHFSGTCGGCLGRDGNNPGGFPRNRQVVVTHLTNGGKEFTHSGGFTLAPPPPWGGFLFGWWAPV

SEQ ID NO: 1023388 - protein, 356 aa, Homo sapiens
MTATTAPRMVEESKVVIPARTKSGYGESTAVVAPRKPVPAASLTSPYPRDELSRHMSQKNPVDTAAIRTHATSHRARGGRVRTIPPRSATPASATQRRHNFSGRKVVASSTMTRVVTDPDQIHHTPHAHGGAQTDAAPHTAAVMATTKVCVGVVREAYVGLIARTASPTSSTVGSTRFGTVTRRCHSARPHATAEPRMIHMGSTHMDAMDSAVESRPRASHAARLRSRVISVHICSSPLMRFAAVGHRYVQHGGDLSDVTAGLVEGEEPSARASCWHDAFTCCVDVVDTDMQDAHGVDDADAVNWTVPLASESLDDSTGDMREQGDDTPRNAAFMDEGTDMEREKAGVDPCSRRLR

SEQ ID NO: 1023389 - protein, 69 aa, Homo sapiens
RGGTRGQEIETSRQHGETGVSTKNTKNEPGMVAGTCSPSHSGGRGGRMPRTREVEVTVSQDRATTLQPG

SEQ ID NO: 1023390 - protein, 59 aa, Homo sapiens
LFHFLQRRDLRGFVYRRAQYRSEVFRPLGGGGQGVETRAIITPKFRFIAHRAFVALKPG

SEQ ID NO: 1023391 - protein, 170 aa, Homo sapiens
RNNYALVKQSEQERENAAADQAWQLFAQGKRIPEAILAQMPGRERVQLQESMRARAERLAKGGKVETDWDLYLQLREQLAAGDPVNLRAYTERIAPAQLEQLVDIQTKARSPGKQPEVATSEQQLSAYTSRLELKGERLGQFKSAAYDAFNEHCAVPAKEPTFEAPEDSV

SEQ ID NO: 1023392 - protein, 44 aa, Homo sapiens
MQALRTFRRTVKNNTDRHKLENLLCFRPMHFIDTLQKRHYLAPI

SEQ ID NO: 1023393 - protein, 106 aa, Homo sapiens
MIGSPKEEQRPPVESYTSHQVVGSMAGDQSMATYYGIEGQDLETMHRGRKNEAQLSDTEPAGEVPVTGQGDTPQRAVRGTGTAIAQHERQQANDRTSKETHRGHDK

SEQ ID NO: 1023394 - protein, 54 aa, Homo sapiens
DRSLSSILLSLWNYILSYGSSVLGPSAIPASGPEIPEAPISVSWAPASSDSSPG

SEQ ID NO: 1023395 - protein, 365 aa, Homo sapiens
MRFAGRSRLLAVLVLPPCSPRLVVSSPLACCPSVVPWYCLLFLWDAFTALSRVCAMDIICLPRGCLSNYALLSLSPASLVQGCVLSWQGLLCPAYSHIRVLSLRDALDVRTIPLAFCLVRPPGPVWNIVLLNDLYGNAKSKGGLPSKLKALPLKCKTLFALPAVIEHIRGCTQSLLTQEFHKTLEDAILKRHIRATSSGSSSLSLQGNRDETHKRAHVTSPMRDAQEPVLRPVRTAWESDVSKFNAVLCSRIRAHLVAVFNEYQRMTGRDIEKSICREMSGDLDEGMLEPVVIMFKNTPAFFAERLNKPMRGPGTKDRTLIRIMVSRSETDLLDIRSEYKRMYGKSLYHDMLGRYLQGIYREDSA

SEQ ID NO: 1023396 - protein, 205 aa, Homo sapiens
MLELNASNDRGIDVVRNKIKMFAVNKKSISYPEADIEDHRFWMKQNMYDRAEPQQALRRNMEIYSKTTRFRLACNASDKIIEPIQFRCAVLRYTKLTEAHILTRLMNVIEKERVPYTDDGPEAIIFKAQGDMRQALDNLQCNFSGFGFINSEKVFKVCEETHPLVKEMIHCVNANIEEAYKIALWHLGYPDIGNIFRVCISWQNT

SEQ ID NO: 1023397 - protein, 281 aa, Homo sapiens
VEAVCGGAGEVEAQDSDPAPAFSKAPGSADIKKLPWSLQEEGNVPNIIIAGPPGNGKTTSILCLARALLGPALKDAMLELNASNDRGIDVVRNKIKMFAVNKKSISYPEADIEDHRFWMKQNMYDRAEPQQALRRNMEIYSKTTRFRLACNASDKIIEPIQFRCAVLRYTKLTEAHILTRLMNVIEKERVPYTDDGPEAIIFKAQGDMRQALDNLQCNFSGFGFINSEKVFKVCEETHPLVKEMIHCVNANIEEAYKIALWHLGYPDIGNIFRVCISWQNT

SEQ ID NO: 1023398 - protein, 111 aa, Homo sapiens
NKTQMDGMSLLPILRGASNLTWRSDVLVEYQGEGRNVTDPTCPSLSPGVSQCFPDCVCEDAYNNTYACVRTMSALWNLQYCEFDWTQEGFGKISLSGCAKPETQYSSYTIV

SEQ ID NO: 1023399 - protein, 241 aa, Homo sapiens
LKDGIIMQTLLIILFIIVPIFLLLDKDDSKAGMEEDHTYELDIDQTATYEDIVTLRTGEVKWSVGEHPGQEVRARSAHDLGAGFLPSLTASELPGSWPDPFPGPPFWFLKLAQPELPFVSSPWSPAFFIKGPGVEGQQGSYLRRKFSGKMDGMPAFMAGGYEVIRPHTSGNGGVQKLVQSLQMDSELRASQQSLGRAMDPTGPQKSHRNIIPLPQPLPPQEALASSAFPRGIKRCVLRNHN

SEQ ID NO: 1023400 - protein, 66 aa, Homo sapiens
AAVQLRVFLRPVLVCAPSNIAVDQLTEKIHMSGLKVVRLCAKSREAIDSPVSFLALHNQIRNWYGG

SEQ ID NO: 1023401 - protein, 159 aa, Homo sapiens
RYRGSRLSTLVKSTACFSATGLLLQRKLPLIGWVEGKPQGKLNILPAAPVLHGRSFQEHGYMKTSPRALFAQALAIVDYRADDKVVPGGNSPEPGSKEAYVIRAVLQRVIPCSSSLERGQSESSQPENLAVAGKRLFCYWSGLDLSSNCFPACSRRGIL

SEQ ID NO: 1023402 - protein, 93 aa, Homo sapiens
DHYWPSYGCRCSKGKINILGTLERFLDLLGETRTLGRKAGWSVCVLRAGATKPSLALAQEDFEAGLISCMSGNQPNHEGGPSARFPALFGCPR

SEQ ID NO: 1023403 - protein, 75 aa, Homo sapiens
GTPDDSTSVLAHGPVRMCRKAGWSVCVLRAGATKPSLALAQEDFEAGLISCMSGNQPNHEGGPSARFPALFGCPR

SEQ ID NO: 1023404 - protein, 42 aa, Homo sapiens
WRLEDPGHKGQQREPKATGVFTTLQPGSSIPPYNTEVTETTI

SEQ ID NO: 1023405 - protein, 255 aa, Homo sapiens
MAEEVLVTGGAGYIGSHTVLELLEAGYLPVVIDNFYIAFRGGGSLPESLRRVQELTGRSVEFEEMDILDQGALQRLFKKYSFMAVIHFAGLKAVGESVQKPLELLQSLPDPGPSMLLEIMKAHGVKNLVSCSTVYGNPQYLLEAHPTGGGGFFFFFFFFFLCTFFAISTPQVPMPLAALVEDPQGIPNNLVSQVAIGRREALNVFGNDYDTEDGTGVRDYIHVVDLAKGTFSLKEADRTVWLPDLHLGTAQAISA

SEQ ID NO: 1023406 - protein, 36 aa, Homo sapiens
MRSSRPSGVDMQGDGAGRAGGACYAVGGLQVPGNTL

SEQ ID NO: 1023407 - protein, 305 aa, Homo sapiens
MALVASVRVLARVLLRAGCPCSRARPSGGLERGGGGGDGARRFGSQRVLVEPDAGAGVAVMKFKNPPVNQPEPWSFCSGSWSVSLEKLENDRSFRGVILSLGPARVSSRAAVDLTEHVWDGAPATTLGTGEGVQELWLRLSQSNLGAGLPPSTEPAPVEGCLVALTCDYRILVDNPRYCSWDSIETQLGIIALSGGKTPLENTIGERAAERCLQVGLLYPAGGGPCMLRIVDHVVPGRSSVQSTECQPKPREGIQNMSKGDQALSGRACSRWSHTRKGVANGGSPRPPKPQSEEAEKVKGHVTKP

SEQ ID NO: 1023408 - protein, 299 aa, Homo sapiens
MTEGVKTLSLDDAERLVSAEDVLLGAGESGKSTIVKQMKIIHEDGYSEEECRQYRAVVYSNTIQSIMAIVKAMGQACRSTLRDPSKMRTDCQCRLFALSCTADVSNGVLPDDLSGVIRRLWADHGVQACFGRVNGKYQLNELRLAYYLNDLVAYCIRVTTSPRSARCATDPSYETTGICGDTASPFKDLHFKMLDVGGSAGLSGPKWIHCFDGRQQAVIFCVVLDAPNDLAASCRTRTMNRMRESVKLFREHSCTEQRWFTRQRPSSFVLDKKDLFEEKIQTQSLDHLVPEYTGGKIYE

SEQ ID NO: 1023409 - protein, 136 aa, Homo sapiens
MDVGCYKKMNGPTTVDINRGNEKGCNKNQQQGGGAEKEENPRGGGTKNIRGEHPIIVDPRGPQKGESEHKKHNGNGAQQNTKRYRQREQPGKEGTLWSNTPILRGADPNGKQTLKKIKRREEKYKWQRITAVNQRG

SEQ ID NO: 1023410 - protein, 73 aa, Homo sapiens
FNRHPRDHLPQYSQLHFLDHHQGDHLTQFSKLHFFKSTPPRPPSHSTPSFTSLITIIETTSHSFQLHFLDRHH

SEQ ID NO: 1023411 - protein, 107 aa, Homo sapiens
GAGSTSSDGWTGWWPWAVSICWQARRGGRQRSQSPGLVVQLWASQFTSLRLSLFPCAQRAAGGWIHDDKRCPGQGLSMLRARCKPPFSPRLLLFLLFQPRTQHKPGM

SEQ ID NO: 1023412 - protein, 144 aa, Homo sapiens
NRTRKEQVLSEQEGELQALREQISRRQEERAELHTQLTQKQQEAERRDAMYQEELGGQRDLVQAMKRRVLELIQEKDRLWQRLQHLSSMAPECCVACSKIFGRFSRRYPCRLCGGLLCHACSMDYKKRDRCCPPCAQGREAQVT

SEQ ID NO: 1023413 - protein, 64 aa, Homo sapiens
MLAGAHAGRGEVPVVTPDRRGRSSRTRQSKPPLTAVYLLSGGRTWLATCGPFNAHMSDDILNSG

SEQ ID NO: 1023414 - protein, 96 aa, Homo sapiens
SQPDPALDAGAICTIFSVVAISEAATGGTEETIIVLSPTILADAPSNVVFIPPTLTKQALLIQIGLLRPSTIIVAEISVPISRHRNLQMRKLRPRN

SEQ ID NO: 1023415 - protein, 150 aa, Homo sapiens
HEPALIWAQKSCLSELTGLLDSQDKRRLSFITKRFVSFVVLQTPNFIEFRSPGHESVRIVGDKTMMVSSVPPVAASLIATTENILHIAPASRGWKADAPSNVVFIPPTLTKQALLIQIGLLRPSTIIVAEISVPISRHRNLQMRKLRPRN

SEQ ID NO: 1023416 - protein, 35 aa, Homo sapiens
SRGSPVERERMYGDGRDVGEGEDVEREGMSERERM

SEQ ID NO: 1023417 - protein, 97 aa, Homo sapiens
MWLACSMGLCRVYYSSLSTVKFVADERPFISEQMSLNFRSSNGTWHASSDSAAVCKTSSYLAMVSTPVKVMPSSELLIFNALLLQAVHVHLQALLPV

SEQ ID NO: 1023418 - protein, 167 aa, Homo sapiens
SRHTCLMTRRVFYRNFIRLHTSDSGLYTCTVKNSAGSVSSSCKLTIKAIKDTEAQKVSYDKRLLKINTLEKTSVLSKRKFPTKALKVWTEIQDRQQAQISKQKFSPLKQEAYKGSRFLEEVKQIQQQTSPGTKSYWSYAGKSTQIHLQRIQQASPATLLLEHSQAII

SEQ ID NO: 1023419 - protein, 56 aa, Homo sapiens
AVQLRSPLQKMNPEFKHGRRNVHMGLLSYAKTGELASFIMHAYLHIRSTYSATGTA

SEQ ID NO: 1023420 - protein, 71 aa, Homo sapiens
PGKKWIQPTKATSHRALFPNYWHPSSPQEAQNRGETCSYFLGRNLDLQEFCLSGQHLLGRTGNQWGGDTPR

SEQ ID NO: 1023421 - protein, 72 aa, Homo sapiens
MLSCVSRWGLMDFGDLDWGDCSRSLLQLLQCPVASGVRHCARGSPVGVRRLGLGDSSRFLSPPSASSTPSGG

SEQ ID NO: 1023422 - protein, 40 aa, Homo sapiens
QLEQLVTLVLLCALSVHRTEYFCNSNSSCLTWIGALKPLG

SEQ ID NO: 1023423 - protein, 66 aa, Homo sapiens
LEDPCAHPTVNHHPNSRRSMRADNILQTIGNTPHVRINRLFGAGANVWIKSERGNPGGVTESLHSL

SEQ ID NO: 1023424 - protein, 103 aa, Homo sapiens
MYTACVKTRPCGVGEARRWPLSCWRRRSFRRGPKWKVTFIVGMERRCKWRQANAKGRKSIRLSNFPAASGHNISHVYTNIFGHGCLLQALGVKWKVITKNAYK

SEQ ID NO: 1023425 - protein, 54 aa, Homo sapiens
SRGSCRRTVAAKARYDLKVLLLTYKASIFVGLASIFSDLVLAVHTYTYATGTAV

SEQ ID NO: 1023426 - protein, 68 aa, Homo sapiens
RSYQVALFLLVMGKLGVDEDKYLDLVTDYGNMVSVAVPFGLAYALDHGYVKEGDTIFLMGTATGTADS

SEQ ID NO: 1023427 - protein, 42 aa, Homo sapiens
RVWRAPAILRETSEWNSIDVIARHDRYRPAHLSGPNTCARGP

SEQ ID NO: 1023428 - protein, 71 aa, Homo sapiens
LRPLTGRATGTVIRNAVGYTVSWKQGEHQIWTLRPCRASVISTTQVQQRFLVVALSVLLDIIVQGLAEAGS

SEQ ID NO: 1023429 - protein, 43 aa, Homo sapiens
WWTWDETPFSLPLDPQGFLPPHVGQDVQLDVADRGPVVPAHDG

SEQ ID NO: 1023430 - protein, 122 aa, Homo sapiens
QRAPSQLRNHAQLGLSFSPTHGHGTQTDLITVSTGGLHITKHNSQSTAPVFLDLSIASTVMDNSLLKRLYSASRKLHSGSSSSLSPRSGFPQSSELRPLPHSLGELTQTQDFSSLPADNFQR

SEQ ID NO: 1023431 - protein, 238 aa, Homo sapiens
GDLGAPGPLEQEAREVSLESVVCKVPTGPAGPRGANGAPGHDGAKGDAGAPGAPGSQAPLAFGNAWLERGAAGLPGPRGDRGDAGPKGADGSPGEDGVRGLTGPIWSSVVAAGCPLCDYTGDEVVPAGLLGPTGARVAPLEDLLCDSWSAPVACWLLPGPPGCCYGTIPGWLVGANTGDAWCLSRLMLGPALALAVIPAGTPEPIWLDLFGGSVRAMGCSLGSVGYPRGAYWVSTVCC

SEQ ID NO: 1023432 - protein, 73 aa, Homo sapiens
MRIPPRTVAPDGSVTFTPDKQFVGKPDPVTVKRVDKNGTPVTATYSPEFTKVTPTGTGATSTGPQGLPQLVRR

SEQ ID NO: 1023433 - protein, 49 aa, Homo sapiens
MIPIWWDTGGKLLLCATLYLQHGDHLLTLFSWRGSEPPNVPHCVPVVPP

SEQ ID NO: 1023434 - protein, 61 aa, Homo sapiens
MLEPPHGPEPRFPARLKTISLVIRGTQGAEEVLRAHEEQLKEAQAVPATLPELEATKASLK

SEQ ID NO: 1023435 - protein, 161 aa, Homo sapiens
MMNFLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASYALSPSSHRFA

SEQ ID NO: 1023436 - protein, 118 aa, Homo sapiens
MKLNVSFPASGWQKLIEEHDERKLRTFYEKRMDTEVAADALGEEVVGDVIRISDGYDKQGFLMKQGDCDLCTRPPASEYRRIPVTDQGDLQNEREDQFVLALSYKSERSQLGYCKKGE

SEQ ID NO: 1023437 - protein, 154 aa, Homo sapiens
TGDAVGQNRTKLVDSKIVFPHGITLDLVSRLVYCAEAYLDYIEVVDYEGKGRQTIIQGILIEHLYGLTVFENYLYATNSDNANAQQKTSVIRVNRFNSTKYQVVTRVDKAGALHIYHQRRQPRVRSHACENDQYGKPGCSDICLLPTATRRGPA

SEQ ID NO: 1023438 - protein, 79 aa, Homo sapiens
MVTRCNSRRDGRQSVPSCTIVGFRETAGNETFIVFPDCMISSLAVPVVVEYSALLDDSWSRSSSLGSRGPNPEQRHRCS

SEQ ID NO: 1023439 - protein, 41 aa, Homo sapiens
CYGGSVKPFLLDKRTGQGAGLREMNAQSLQDAAQGGGTSVA

SEQ ID NO: 1023440 - protein, 53 aa, Homo sapiens
MSRQYMSPPLIRRPSRTVPVTILAVLLVAAGVVAIIAAIQRLQHGSLPGWLAW

SEQ ID NO: 1023441 - protein, 44 aa, Homo sapiens
AYSGLVSFVNALYFAGVQRGDPVDHADADPARRTQTWRPDAALA

SEQ ID NO: 1023442 - protein, 93 aa, Homo sapiens
YRLLEEASKKKDKGHSSSKKSEDSLLRNSDEEESASESEHWKGPLPESDEKSQEEEFDEYFQDLFLGDEREKPSLLNVKLHEVLNFMQFEIPY

SEQ ID NO: 1023443 - protein, 54 aa, Homo sapiens
MGIEPYELQSNVECTSINEEITHEAQSQPILHQVVPDNQKVHSANEQRNVNRNE

SEQ ID NO: 1023444 - protein, 100 aa, Homo sapiens
MGQRHFNLKTKEKSLLAVITKKCNSPSYEKQPGTLTPCYEWPLPALLGESYTSKHSSIAAVVPKDSEEPSEITIHARTLALNDHHPFYLNFGPIKSNDKQ

SEQ ID NO: 1023445 - protein, 44 aa, Homo sapiens
ERLLENTGQSERITKRLPDSSVMKSTPRSSGRSQRLSRSRGSTR

SEQ ID NO: 1023446 - protein, 326 aa, Homo sapiens
CTGRVLRGRTRVAGAAMVKISFQPAVAGIKVSTMADKASRVGPCRRASDTWDPADCLAREEQPHNIGSKRGSSVGGVCYPGPMRALSRCIALLGLVFASVYIYEILLSCTAGPEITSFRCGVLYEDSLSLPGPDFSMELEEDVKIYLDENYGARLTCLVPQFGGGGPADVHPMTFQRGSDWYHDISLDKCYGHRTLDTIGDSPHSNFWELLIERQQGDLTVTAERTSFQEDMGGHVHANVTLTQGRPLRIRSYSNLVPHGANSSAHNGGPVAPGPHTYQGRIRNALRPQTRANVPTRDNLTQTPYLAAKTRSISQGFRCEEPMLTP

SEQ ID NO: 1023447 - protein, 57 aa, Homo sapiens
MGLRALDVVVQVAPERVDQVEGVDSSTGIGVTRDQPKGIVANVVTQRGDCVYQLQRR

SEQ ID NO: 1023448 - protein, 58 aa, Homo sapiens
LDYSELEVGHEVAEDEDAGAALQWHWLRLLLHCIAAGGLDVHLVRTAPPPWSAAVVSI

SEQ ID NO: 1023449 - protein, 76 aa, Homo sapiens
EDPCTVVHTCTVVHTCTVVHTCTVVHTCTVVHTCTVVHTCTVVHTCTVVHTCTVVHTWSLYRGEWGYEQQCRDPLE

SEQ ID NO: 1023450 - protein, 74 aa, Homo sapiens
EDPCTVVHTCTVVHTCTVVHTCTVVHTCTVVHTCTVVHTCTVVHTCTVVHTCTVVHTCRCIGGAVDDRDPQNSH

SEQ ID NO: 1023451 - protein, 71 aa, Homo sapiens
EDPCTVVHTCTVVHTCTVVHTCTVVHTCTVVHTCTVVHTCTVVHTCTVVHTCTVVHTWSLYPGGLYTSGGV

SEQ ID NO: 1023452 - protein, 75 aa, Homo sapiens
EDPCTVVHTCTVVHTCTVVHTCTVVHTCTVVHTCTVVHTCTVVHTCTVVHTCTVVHTPPECYNPPDTATRYEQQC

SEQ ID NO: 1023453 - protein, 85 aa, Homo sapiens
EDPCTVVHTCTVVHTCTVVHTCTVVHTCTVVHTCTVVHTCTVVHTCTVVHTCTVVHTWSLYRGCVGSVESASYPEEYEQQWDPLE

SEQ ID NO: 1023454 - protein, 113 aa, Homo sapiens
PRENSKRFVEGQNARGQGYVNETVKPEPRKNRPPIAIVSPQFQEISLQTTSTVIDGNATDDDKIVQYHWEDLKEPLREEMISEDTAISKLSKLVPENYTFSVTAVDSDGATNS

SEQ ID NO: 1023455 - protein, 51 aa, Homo sapiens
MVVLFDRARSFGRDAHGAVREEGDTRLASQISRINPGDQWGDRALIAQAGG

SEQ ID NO: 1023456 - protein, 226 aa, Homo sapiens
MVLADFLSIPYIRNVANDEACADVYRQVRRTAPGRPTTPAAWPPWASLKATWLRQIRGWGERYEKALTPDAPKWEAVRAWLKDKMPADHPTSSIVHNDYRFDNVILDRTNLMQIIGVCWDWELTTLGDPGDGTWATPSLNGSGAADPGGLVPLMRRQPSNAPGMLTRLQFCDYYAERTGIQIDNFDFYNTYGLYRLAGIVQQIYYRFFHGQTQDKRFAQFIHMTNC

SEQ ID NO: 1023457 - protein, 51 aa, Homo sapiens
GIHARGGHDGDAHLRRMGASHNWHPTYVRFGPDSQSPAVQPTDFQRRLRDD

SEQ ID NO: 1023458 - protein, 70 aa, Homo sapiens
WNEREALKMDHGRDCMSRRVSLMTLRPTRDRQNVVQLKGVYFTTFFKTKQNKTTKKMEKKTGVQAPVLHV

SEQ ID NO: 1023459 - protein, 67 aa, Homo sapiens
EGCLHRQVVLHRQVVLHRQVVLHRQVVPHRQVVLHRQVVLHRQVVLVLNSSIILSMHGPLELIVTYV

SEQ ID NO: 1023460 - protein, 50 aa, Homo sapiens
MSSLRSLYLRWCCQVQDFGLKHLLALGSLRLLSLAGCPLLTHHRAVGLVG

SEQ ID NO: 1023461 - protein, 77 aa, Homo sapiens
ARPVAGLLQTIIGYCSLLWRAQFDNYVSIGPACFNHAPGGRSPKLVLRCWRCLIDTGRVRYAIIGPALVEWGHVATS

SEQ ID NO: 1023462 - protein, 97 aa, Homo sapiens
GPVPLKISYAEGFGLPVIEALSVGTPVAVASGTSLDEITPPSAPRFSPTDGPALVQLMLSLGERSDESSAEQRKQWAERYNPNAYRRRLAELIEELK

SEQ ID NO: 1023463 - protein, 96 aa, Homo sapiens
GGYGARVEKSTSEHAGEGRGHVFPAVGNAQVGDLVGPHGFGQQGAVPRHQRAEQQHQQVDEDLQTPLAGRRQGVGPATRSRCGRRRARRRRGPAMV

SEQ ID NO: 1023464 - protein, 86 aa, Homo sapiens
PAHFSEVRVVRAFDYPIAGRSFRFAIHPPVRASGARRLRHSEFKTGRQCGLLHMKAKRRLISAAERHLAEVVRVQGETELVRLIEQ

SEQ ID NO: 1023465 - protein, 129 aa, Homo sapiens
MWLVLFLQIKFYWDKAKPIICKLSINIFMLQQSHQFQHETHLVSRSCKISHYLGPLQAQFAQTYSFNIHHTASAISIAHLSHHNTIVGTRDLLFFLEHGVLPLLHQRWTCSWHDQWAHVQPSATDYTHR

SEQ ID NO: 1023466 - protein, 66 aa, Homo sapiens
GVVEGACNPSYLGSRGRRICVNLCGSRGCTKPKSRHCTPILVDHCRPRWSDQSVTEVTDISSIGPF

SEQ ID NO: 1023467 - protein, 93 aa, Homo sapiens
IKIVFASCVSFKSEFSHSSGKRKKFIMVQQQSYKGQKQHHFQSRTYVTQKCKQAEARLVEHLRDSLDSKVFKETTSTLQGSTVVFMYNNIFNQ

SEQ ID NO: 1023468 - protein, 175 aa, Homo sapiens
VLGSTVVDSAWRESPEQGQCWAQGWRVSLLCMHPECTHPFTDFMELPSLCSVTAGTAACSQWGGHGDGCCGRARCMGFPAGVPLRMCVLLGRAPWAWRSVSERFESEGPEITGAVVSPRAHGRHLGKLQVCGGGRWGMYSCPLRARAPRLSAVCVAPSEEGDQGEGRGTEGMDEP

SEQ ID NO: 1023469 - protein, 38 aa, Homo sapiens
GSARIKTAALASLKKYGVGTCGPRGFYGTFDVHLDLED

SEQ ID NO: 1023470 - protein, 46 aa, Homo sapiens
PLTRSPQQAAVLHAGPGGDGPQYAAGVHSFGSKDAGFDYLGKLQSN

SEQ ID NO: 1023471 - protein, 35 aa, Homo sapiens
HSSFDLQLGPLAKSSRPLIILLTGINCKICRRGRE

SEQ ID NO: 1023472 - protein, 119 aa, Homo sapiens
MGTEILVINTCPKSYTCELMAPDYKLESHSPTRRNFLQFTHQHFYKVSTAAKKFTFQFKASTYKEDRESGNFKTNFCAHFIEMGTEIENVIWVHVMCGETLKQSENEELSQNNGKHVNF

SEQ ID NO: 1023473 - protein, 89 aa, Homo sapiens
VLYTRDKSCSSMTLCYLLRTPSHHPAPLGPTLFNIALSCSHPNPFQGLPKPLNCAERARASTYHRDELQEGSITYTGSCSCSPGTRWIS

SEQ ID NO: 1023474 - protein, 32 aa, Homo sapiens
MIAAAAQLRGPRGRQPKFDLGAGGRVAPVASE

SEQ ID NO: 1023475 - protein, 108 aa, Homo sapiens
RVSSPFIAQGCRHPLSIAQGCRYPTLPSLRGVDTLSPSLRGVDTLSTIAQGCRHPPFIAQGCGHPLYRSGCRHPFSIAQGCRHPLSIAQGCRHPFFIAQGCKHPISIT

SEQ ID NO: 1023476 - protein, 43 aa, Homo sapiens
RLVATAPIMCAQAKNPSLFPFSSVPMNFFRSHLPSFIEAVAYA

SEQ ID NO: 1023477 - protein, 161 aa, Homo sapiens
YSEGVVDSVKGGFTSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIIQTPC

SEQ ID NO: 1023478 - protein, 35 aa, Homo sapiens
SVFQCWEDYRDDDQCMRMTSRNQLRAELEKHGYKI

SEQ ID NO: 1023479 - protein, 105 aa, Homo sapiens
MTAQAPVITSTFQPVGRGKGKGGNLNLHMVSHVTTLYGKEAWGCELFSHGRKQGKREKEHPAVSPGGHSCQVRSSSETECARLVEYGEELTRKIHVPSPCTVRDG

SEQ ID NO: 1023480 - protein, 46 aa, Homo sapiens
MLRVLAYIAARYNLVGIVFHRGGPCGGAVAFTVLQRFLSAGAVGVG

SEQ ID NO: 1023481 - protein, 37 aa, Homo sapiens
LEDPLENVHRYCIGFSAEEEEEEEDISEESPTEHIFQ

SEQ ID NO: 1023482 - protein, 60 aa, Homo sapiens
MGRRMSARECVSSPVGYWAVRRCCQSWAGQPGRRGGRQSRSVERDEDVGGTDVAEPRDCA

SEQ ID NO: 1023483 - protein, 175 aa, Homo sapiens
GCGGCSELRLCHCTPAWATERDSVSKTNKPQIGLSLSWLNTFQRLPITLDKKSTVSTMPWKALCGPAPARLSDAISGCSLSLIRIKTQELLSLPLDMKLPLPRVIRSCCSFLESASSRLSTLLSVQTPPLQRGLPRSPPTQCLHLHNLSMLEKKFSIMCDRGLRRALRLPVTPLQ

SEQ ID NO: 1023484 - protein, 107 aa, Homo sapiens
REEGEAVPGEGSSELLAGTAQEEQMKGSLLRQWARRQVASSGYTGATAVTTAGTRGCVSSPGTRKFQRLINTLKAVLRPGLSRHPNSTLNRVSMKRSQNNTFIKIHD

SEQ ID NO: 1023485 - protein, 137 aa, Homo sapiens
MSLSEALWIGDCLIKDRPHRGTLRSLHWHELLLEDAQGLVGSFVDGHVFWRIYSIREQDQPPSVLLVGTFLKVVVNEIDEVPKEKGRTVKRNSPSLPYLVRLVAPTWMPIAEPCEVHQQTRKISTLCALPLAQGAGF

SEQ ID NO: 1023486 - protein, 126 aa, Homo sapiens
DASLRLVACSGWSIASCVSPGAARTVGVRLAGETRGPARRAGTSGEGTSSNVAGSPERIPPRRAGSRVERTTSRAWQSTKGTGERSQYFRIVDGMVHSEQNQEMVGKKCIHITGMSLLGLHGTMEK

SEQ ID NO: 1023487 - protein, 38 aa, Homo sapiens
MGLLDTAGGRSALPSRLGGQLLARSLAAGDLRTVTDSG

SEQ ID NO: 1023488 - protein, 49 aa, Homo sapiens
VGPQIRGMLGNLISVREAVHRESYTDFYRPAVSRFQLVSERMQVVERKG

SEQ ID NO: 1023489 - protein, 136 aa, Homo sapiens
IPEYAVHGSISLTGCPGRSRRIHVSALSGYTTSRHASNTGLSPSMIVLSRTFFSQSKYDSVVLQTLLSVATEQVWAIPRSFATTRGIIIYFLFLKVLRCFSSLRSPHYFCSDNRSSTYWVVPFGNPWIKGYLHLPK

SEQ ID NO: 1023490 - protein, 77 aa, Homo sapiens
GQQGCSQERPSSPVEGETSSWGLNSEHNRKKRVTPKTATGVELEIKITDTPLLFVSSSPIMSPHYSPRPFLYQEAPP

SEQ ID NO: 1023491 - protein, 52 aa, Homo sapiens
SQARPLFWQAVYRDSLPDEASFINVDRKFLHFFTFSIVSVAAEEVVVATGTA

SEQ ID NO: 1023492 - protein, 42 aa, Homo sapiens
ENIMCVNKTGTRIKLIDFGLARRLENAGSLKVLFGTPGPLLS

SEQ ID NO: 1023493 - protein, 58 aa, Homo sapiens
HGQAIVYGPQFVQDGIHNFFRNIGDVGNFANDVLQLKPHAAGVDTARLLMNGPKMCKI

SEQ ID NO: 1023494 - protein, 65 aa, Homo sapiens
EDSHGNFSTIHRNVKAYLLAVIGAEYVLNMLPRGTHDYAKFIRPSELSAFVRTAGLQAQEMRGLE

SEQ ID NO: 1023495 - protein, 49 aa, Homo sapiens
VELSLECWGNTATPEATIASTRGLSIPIAWAACLTLQSVAETHSHTQAW

SEQ ID NO: 1023496 - protein, 71 aa, Homo sapiens
VLEDHRSVNIDVSEGIAASELKIVSQLHMRLQLQALGAHSSYRAIEVVLWQFGRQVFLIDTEQRRGEQVVG

SEQ ID NO: 1023497 - protein, 70 aa, Homo sapiens
MQYRRPLLQACHFFCGFRSPLGSGIEAEVLVVESFEELKKRQKEAIGKIVVYNQPFVSYEETVQYREFGA

SEQ ID NO: 1023498 - protein, 134 aa, Homo sapiens
TVMDVGIHRYSAPGVGWSGVRLVAQHAQQVSRADFSRYDLILAMDQSNLRNLKAMQPAQGKVDLDLFLRRYDSVVDEVPDPYYEGDQGFETVLDLIERACDLLVIELKGLVMTLQVLAQVSLKPFNSFGIDVRA

SEQ ID NO: 1023499 - protein, 82 aa, Homo sapiens
GVRCLRGNGIQCFRGEKPVLIFDILQCLLFTYRSFSPYTSPSNYVQMCRDLLSGLSPKALTLGLYFVPSPPPPPVTGLVTFT

SEQ ID NO: 1023500 - protein, 69 aa, Homo sapiens
PPPLYNSNHVQQKHHWLSRWSLSSEYLNGNGVPEQLDSSSWKSMQSAKPSQQLVGWDTACWRRHTPELH

SEQ ID NO: 1023501 - protein, 70 aa, Homo sapiens
IADFERIHRVDLVRLENLQKILTNIFSEGMHWISHEEIDTIPNDLSAPGESEPQFSDQLMILTRFFLSGG

SEQ ID NO: 1023502 - protein, 151 aa, Homo sapiens
ALDAQMISLGVSADDFEELVWRGARLLRQADCVSNGFAAVLQQVDALPLGDGLWWLHSEQTVKRPGLAFVTPDKPMRYLGQPLHGLFCLASLGEAHQTLLERLCALLIEGRGQELGRATSSRAVLEVLGGELPPDWPSARIALANAHGLHA

SEQ ID NO: 1023503 - protein, 90 aa, Homo sapiens
MASRVPNGDACGWPASCLGSVAGLCHCVWTVEVAGTLVAAALPLAAAACPMVQRALHGVVDVAHFVPAHLILNVKPNQLAVQTGKTDVQT

SEQ ID NO: 1023504 - protein, 58 aa, Homo sapiens
EAGTVRYKWDLGEPECGTKYLLNLNLEPFSEKSVPLCILYEKYRDCLTESNLITVRWP

SEQ ID NO: 1023505 - protein, 133 aa, Homo sapiens
MPVVLRAGIGHGLVSDSVPIGLNICPSLTFLINCETVGVAAVVRIVPGVVNRTLSVGFSVCWVDGASGAVVVAVKSTTSCSSRAVVETAWLSSIEERVERLLEGVVTSHLNSSSSREPSERRSRGYGLRHITS

SEQ ID NO: 1023506 - protein, 42 aa, Homo sapiens
PLVNRRLQLEGGTGLRRPIETGLVETEKTLAFLIGTYWSYAA

SEQ ID NO: 1023507 - protein, 152 aa, Homo sapiens
SLKVVISRLVRSIRDLTASECSKLWGSKHAKPERGPFQKHDGLYVIRDCDESGSLRPSMCNGATFPRVVPWGWFGENTWGWGSARTDKDTEITCSERVRTYWIIIELKHKAREKPYDSKQFCGLHFMNGDHNALSIWIQNYSPSFPYENNDI

SEQ ID NO: 1023508 - protein, 116 aa, Homo sapiens
SLECHTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTLVAQ

SEQ ID NO: 1023509 - protein, 161 aa, Homo sapiens
MSSGLFMPKLTKLTIYIKPLLSLPDKLMGQMPRMKEFYLYDTNLSTVPWSLFANMSGMERLSLHLNNKLRELPPDLFCCLPNLQKLSLKSNDIQDLHPDIFSKLANMNTLLLNDNKLRSLSEDIFKGNPSLASVELKNNQLRTLPGEVFSTAGGLRVVTLS

SEQ ID NO: 1023510 - protein, 272 aa, Homo sapiens
AEGPINPRTRVTVRVFSNTHQPEGPSERGLHFFPSYSVSLSRKAKGKEAIWEAHHPAQEEMKPGGRRMSGMTPHLCNSHVLLLPLAWLIRGPAPGSIQSVFLLLASHLLCFLRDVSVAASEPTVYRNPTKMSCQQNQQQCQPPPKCPIPKYPPKCPSKCASSCPPPISSCCGSSSGGCCSSGGCGCCSSEGGGCCLSHHRHHRSHCHRPKSSNCYGSGSGQQSGGFWLLLWRGLLLTWTRSSTKGISGRRTHCSLEFYLLHSLAFAFWSPIN

SEQ ID NO: 1023511 - protein, 125 aa, Homo sapiens
VECIHQQVVGQGLRSDPQQVVGQGLRNDPQQVEGQGLRSDPQQVEGQGWWSDPQQVEGQGLRTDPQQVEGQEVEERISWTFCEGQVLRSDPQQVEGQGLRSDPQQVEGQVLRSDPQQVEGPGVEE

SEQ ID NO: 1023512 - protein, 53 aa, Homo sapiens
APANRRCPEAPSVVGLVHVALSEIRRYQKSTELLIRKLPLQRLVREIAQDLQR

SEQ ID NO: 1023513 - protein, 141 aa, Homo sapiens
HTAELGTTLLSSYPNPGSSCDLLSSSPNPGSSCDLLSSSPNPGSSCDLLSSSPNPGSSCDLLSSYPNPWLLLRPAVLIPNPGSSCDLLSSSPNPGSSCDLLSSSPNPGSSCDTLSSSPNPGSSCDLLSLYPNPGSSCDPGL

SEQ ID NO: 1023514 - protein, 95 aa, Homo sapiens
MHCFGVPQKASSSVLWGGRGVEETGSHQQGASPTACPMSSVPRAEPGTRSNGCLEPWGSALDVRPVCWGLSSSGEARGPASPTNLTKSAQGPASP

SEQ ID NO: 1023515 - protein, 74 aa, Homo sapiens
RAYTEQMLKEIKDYAQSDTAKQLEPGFTPRPDAVHEHFTTALYAHSLGSPSPVYNQSELVTTQKHRHSLNLFYS

SEQ ID NO: 1023516 - protein, 116 aa, Homo sapiens
GPCYWLRVDYSRGEGVCSCCPERVAEWDAAIGRKSIDDQFIELMDALDGYDSPEAISQRLAELQGPIRELAAACRQTVLFTRAQVEFESTKADIKLRPMEGGCLFAAWYLLMDRIA

SEQ ID NO: 1023517 - protein, 92 aa, Homo sapiens
SQIIAVINVEADHLDNWGTPQAYFDGFVSMATRPEVRYVVTNADHPGAAELACRLESTGTVRVVTYGESEQAEVRLVDLDLNGTTASATLVH

SEQ ID NO: 1023518 - protein, 37 aa, Homo sapiens
MAKNQAPPSSNHSFPEGALSPNHRTRYREILIAVDAA

SEQ ID NO: 1023519 - protein, 119 aa, Homo sapiens
MSPPVMSTSVPEDTPSNAKPPPCQEPVRDNLGSLHLIPGCDSCETFWFWDHSENSPGKRSQKLTLGRQNTAHSQPETHGLMFLFTNIPSLQDWPGDPPPSDCPGPHLAKHGGRETQARV

SEQ ID NO: 1023520 - protein, 169 aa, Homo sapiens
AVEDGPDDYDEEDEDEVEEEETNRLPGGRSRVLLRRYTCKSLPRDERCNLTQNCSHGQTCTTLIAHGNTESGLLTTHSTWCTDSCQPITKTVEGTQVTMTCCQSSLCNVPPWQSSRVQDPTGKGAGGPRGSSETVGAALLLNLLAGLGADGGQETLTHGPSPPPTASPV

SEQ ID NO: 1023521 - protein, 86 aa, Homo sapiens
SIQYRVCKLSSVVILRNMGRCEMHLVWGCQWCLRYAYVSSGDLYRARRALMVLWVAETYAYLTASSGEANQKLKRKQPFVSHLPVT

SEQ ID NO: 1023522 - protein, 84 aa, Homo sapiens
LEDPTRGRIASMPVWILVDPALHRKRGNARVQAEHEGSDAGRGQIQMTRLLGADALAAELNARTPVHMDRLDGRQREQQRRVHR

SEQ ID NO: 1023523 - protein, 123 aa, Homo sapiens
MRSFPQLGTSTVHLGTSGTPSSLPRPIVPGPLLVPFTLNFTITNLQYEEAMRHPGSRKFNTTERVLQGLVRVQPISLCLAHLTRFHLHHPCPGYRRRSHVNHLRPRVTSPTHWCQPHPPISCH

SEQ ID NO: 1023524 - protein, 60 aa, Homo sapiens
RVIPRAEANNCSPNSGWPAGVRLALMGIEESSAPAVDHANNRRVAEYLLEEILERLEPRD

SEQ ID NO: 1023525 - protein, 54 aa, Homo sapiens
EPFQGDMNRGTFLAIQNKFLARRFKLLEQALVIEEQLRRAAYLNMSEEPFSLTL

SEQ ID NO: 1023526 - protein, 59 aa, Homo sapiens
MLAVAPVWATVLAGGWAVVNPVPVSLCRAMGADIVIAVDLQHDAHLMQQDLFSIRIEEE

SEQ ID NO: 1023527 - protein, 44 aa, Homo sapiens
SSSWSFLSIGPQAPGTRHTSAEGEPLNSRSKGQRGTPGANRGLV

SEQ ID NO: 1023528 - protein, 75 aa, Homo sapiens
IEAPEVEVGLSALEIFQAALAHEEKVSEAIRELYRACTSAGDIDAIPLLQWFINEQIEEEATVDEIVGRIELIGD

SEQ ID NO: 1023529 - protein, 98 aa, Homo sapiens
MGAHTCRKKENGERRSRNKGWGPPQHKKTHSRRAGGRAANRGGDERDKKTTTHGEGRATARRGDNAGRTNKTAGPGERPAHRDATKDRTAPAGRGGGG

SEQ ID NO: 1023530 - protein, 101 aa, Homo sapiens
SGLRFHVRSKAPFTKICDGVVEVLASEPSRRDFLGHQIPAELNRDLYPPELLTRLEGIWLPGTGSSSRGISCVCPRPMAPLRACLPSPGSSPVQVGALLPW

SEQ ID NO: 1023531 - protein, 445 aa, Homo sapiens
GGNCTVEDAAILKDCGQLCAFCDAQSTQEIHEKVLNEAVGALMYHTITLTREDLENVQRPSASSVLDMGMWFLTTSDINVVPGIKAFACLQQCPAASCGGDRPDSTLCPHPEPVPAGHLAAPGAAGGHNESRASEQDPGRGWRTGRYTGIRRGRPMEHHRTNGRRGGRPSVQHAGPKAPTVTNNDCTYNGPINMYGGMRVAAVSLGTASRMSSNHMTGPGHIYQQRRQQALEPIETGRDQQRKPTQQPKLQSPTSHTPGHSPDQTDTRGAVPIARHNRHRGDEDQEMDNQQEQGKAMSPKEHRKAEETEEAHRKAQSKSRKDPIQRKGKTPTKHDDRTACHHNIPKRKEARNMGKGAHAATPTHRRNRQPDHDPIRRDGQSKNTRPDDEETENKRKGSADTRKNSERRRTQPRRETRPPHSTGQQREQSSSERDREQEGRTPDTK

SEQ ID NO: 1023532 - protein, 110 aa, Homo sapiens
EIIQLALGGSVWAHALNASGSGASAAGFVSTQEDRIRELAPHGMIQQDEDAGTDVGGGGAVDLIQESPGVGEPRDAGVPSRVDGQGLNVSLHGSSRAKPISRTYLSPVAC

SEQ ID NO: 1023533 - protein, 62 aa, Homo sapiens
PPTCGRSTKVWRSHRGHTEATNNELNLLGGINISADDYNPERVIFDIDNESYVTKSGDYFTE

SEQ ID NO: 1023534 - protein, 39 aa, Homo sapiens
SVTCLLTQCVNTTLQIKGKINSITVDNCKKLGLVFDDVV

SEQ ID NO: 1023535 - protein, 543 aa, Homo sapiens
MPRTPVYGYEKISWKTFLKYSEEVLAVFKSYKLDDTQASSKQQMARHCTNQEAEPCHILRHTFFHTQCTHSCMAFHQLQCTVNFRSAPPSCLPVISIIHSHIISKAAGPTFHTSSTLMLIHSCMQHIHFGIAQHHSPTIQFHPTHSILQEPPPHGTNSIFQSMVSSIIIHTPPGISKHLAHSVAHTYAQVCPTVSRRNSNSNHPASPTTLTQHITLPRQQHSMRPRRYSRSGHKAPPPNNTVIWTRYNMKRTFSVPTGFQGKLLSRLCITLLRRTAPAKHIHLAPLDAHYLLLPTYWQPNTPSLKQHSPKLALQCPSNPVTKDTQCVCHTHANLTHLHLLNPTLHTLYMDLALHTPISTSISMYLGRIAALILYISHTTHPTPASLVQDLITTTHISFHSHYGLHLNAYESIESSTGAPLSCGKHYYTRRHALATTNAVYIGCATVYGHYASPSYDPGENITTSVSHSPPTEISQLHGANNGSMQTTIERSRSPDTAPGTQHEQITTRTPSPLAPDGDWRNDVKRHDTTEADSQKILAERTNV

SEQ ID NO: 1023536 - protein, 67 aa, Homo sapiens
ARRYAFCYKEVKATYKDGQFELIPAPQFQQPHSMILGQSPPLWERTVSMCEMGGSSWACCCFPRLDS

SEQ ID NO: 1023537 - protein, 85 aa, Homo sapiens
GLFRAAGVVEVGGSSCGVVQGGPCALYPLSAAVPDATSVLEGQASEDVAQIRDHNSVLLIPKRAGHPSSTRGIEMVDVEARVAHE

SEQ ID NO: 1023538 - protein, 67 aa, Homo sapiens
PGLSLSTHPLCAYVRLPGADCIGPTCPAVPWGTVLGQNAKPKERSLAPALVDLESAPIARSTALQAV

SEQ ID NO: 1023539 - protein, 86 aa, Homo sapiens
VETPLMVADTRWLRSPVVGVGSLRERKQMSESASLSMQEASYVFSTSWCTDSVVLDGSTTVSDTLCEVTTLKCDMMRDGNSSRILL

SEQ ID NO: 1023540 - protein, 83 aa, Homo sapiens
DQNSNLLIEEFRNEFGEIQGDKSEMIWNFHCWVESWMTRPDLQPGYEGWQGLEPTPQEKSEGTYCCGPVPVRAIKEGDLSTKY

SEQ ID NO: 1023541 - protein, 89 aa, Homo sapiens
SRADYTMLRLRTRYTMLRLRTRYTMLRLRTRYTMLRLRIRYTMLRLRTRYTMLRLRITYTMLRLRTRYTMLRLRTRYTMLRLRTRYHAR

SEQ ID NO: 1023542 - protein, 66 aa, Homo sapiens
SRGSRTSILYTRLTLQGKKVRPDYLKAIGKVINGENVTERYRAGKKYNHDRYAEYVKLFMTVLVVV

SEQ ID NO: 1023543 - protein, 49 aa, Homo sapiens
MLSPLSTGLLVATEEMCGQDLRVIHSPIQIVTKQFQHRDNRLGSARDDD

SEQ ID NO: 1023544 - protein, 120 aa, Homo sapiens
MPPCESRSLRRSSADRATLLSLTNLPCGLRRVIEASKPTASAGWSLRALRVLGLWPLFRDRLRWCCYKKQLSRISPRARAWVQIACLGDDHRPKGIGRVMLRGVSPMILGCCTLRAPSHL

SEQ ID NO: 1023545 - protein, 163 aa, Homo sapiens
MPRTNKTEFQLELPVKYAVYMVVTSHGVSTKYLNFTASENTSRVMQHQYQVSNLGQRSLPISLVFLVPVRLTRLSYGTAPRSPSPRTSRVRAITKERLPSHSDFLAELRKAPVVNCSIAVCQRIQCDIPFFGIQEEFNATLKGNLSFDWYIKTSQTPPDREHS

SEQ ID NO: 1023546 - protein, 201 aa, Homo sapiens
PIFPENSEVTFNITFDVDSKASLGNKLLLNANVTSENNMPRTNKTEFQLELPVKYAVYMVVTSHGVSTKYLNFTASENTSRVMQHQYQVSNLGQRSLPISLVFLVPVRLTRLSYGTAPRSPSPRTSRVTCHTKERLPSHSDFLAELRKAPVVNCSIAVCLRIQCDIPFFGIQEEFNATLKGNLSFDWYIKTCITPPDREHS

SEQ ID NO: 1023547 - protein, 49 aa, Homo sapiens
RSTCSGLLVSRLYLVSRLYRVYLERPPFIRVWMSRRHRTPLNRVIVTSR

SEQ ID NO: 1023548 - protein, 343 aa, Homo sapiens
EVALEVLDRGVVPCRKDPKQPGADDAPDVAGMASEGSMEGFVVTVPNKSAEMRSTLRAEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGELRMGSPPSMFPSSREEFLDQNKAREAELRRLRKMNVAFEEQNAVLQRHTQSMSSARERLEQELALEERRTLALQQQLQAVRQALTPSFASLPVPGTGETPTLGTLDFLTGPGFTGTPSKRDPPSTRRLIVRITQILAPVATGTCEDWPAQ

SEQ ID NO: 1023549 - protein, 437 aa, Homo sapiens
RALRGGGGAVVPGPGRGLSWPGGNRTSASRGGGNRPIKGFLVAPALEELPCSLDPVPPQRIRARASRGSPIAGYPEFAVCHRASPGATHAPSRDPCSSVRPGAAHVLTAPKSSPDAGRLCRAGRPMASEASMEGFVVTVPNKSAGDGSTLRAEKGSHEEEPVKKRGWPKGKKRKKILPNGPKAPVTGYVRFLNERREQIRTRHPDLPFPEITKMLGAEWSKLQPTEKQRYLDEAEREKQQYMKELRAYQQSEAYKMCTEKIQEKKIKKEDSSSGLMNTLLNGHKGGELRWVLHLRCSHLHVEEFLDQNKAREAELRRLRKMNVAFEEQNAVLQRHTQSMSSARERLEQELALEERRTLALQQQLQAVRQALTPSFASLPVPARANRPTLGTLDFLTGPGFTGTPSKRDPPSTRRLIVRITQILAPVATGTCEDWPAQ

SEQ ID NO: 1023550 - protein, 40 aa, Homo sapiens
HQSIKGLVGGRGAIVGSHNPQMINLRILALLHSPPCVDCQ

SEQ ID NO: 1023551 - protein, 62 aa, Homo sapiens
IGGTVHCVGGQSRGVFFNKVTFKLQKVTFKHKRGTKHKSQGDKKTVQAERKALPKALRQDSM

SEQ ID NO: 1023552 - protein, 96 aa, Homo sapiens
RIGSSSSARSAHPRLAAPLPALNLGMRPEAACKKPCGTPLEVLLRDHWTVHGLERHSEPSACCPRLRLTTAVLTANCYGTGTAGPKEGAGSPEEGP

SEQ ID NO: 1023553 - protein, 59 aa, Homo sapiens
CRDFLKILPPNELEYKCTVIEFDQLDRNGILGPIRQCSPGRSNVHSSPVVPSGIMVGGD

SEQ ID NO: 1023554 - protein, 127 aa, Homo sapiens
MDPGNENSATEAAAIIDLDPDFEPQSRPRSCTWPLPRPEIANQPSEPPEVEPDLRGKGTHGGALRADPVALSAPRSRPGAPSPESLGGCNRSSEGLPPMPWGSYAELIQAIESAPEKRLTLQIYEWM

SEQ ID NO: 1023555 - protein, 40 aa, Homo sapiens
MHRLGIQAPEVIADQVLGNPAHPGAEGGLAAEAVPVTPGL

SEQ ID NO: 1023556 - protein, 71 aa, Homo sapiens
HRSVMRHADNQTKGLSFFCVMSTDEEYQQAQHKFLVAVESIEPNNIVVLLHTEPLPGLIRYLSAYLVSVRY

SEQ ID NO: 1023557 - protein, 81 aa, Homo sapiens
ALVYATSAVRKELSKASAETVIPNTCAAASLPSCLESDDQVNKSVFQVYSTVRIDSIADSTKEHAMSKNVMEIKIYTPLYC

SEQ ID NO: 1023558 - protein, 35 aa, Homo sapiens
SRMDKEHWDMAVSSIFTSYERGAAVTVLLARLRSH

SEQ ID NO: 1023559 - protein, 113 aa, Homo sapiens
MTSSSWLALRGMTPVPLRAQLMDGHEARTDKRGWYLNAKHSLAIGENGEYYHLVVPGGFAARLRGVKLHPSLPPMHIGRGGRDGETGELKEFLTWLIDSRYGFDGGRGVTLTT

SEQ ID NO: 1023560 - protein, 159 aa, Homo sapiens
TRNVTKDHILDDYSPPMGKYNEWGARGKDCIPIVSNGSAYVEFETPDEAEKALKHMDGGQIDGQEITATAVLAGLAEASPQEIQPSQENVATTAYVAQVSPMDEEKVPLPEAQVPRAPEITVPGPAPPQEPPQLQLLPDKQATEALAPVTYTPPSSVER

SEQ ID NO: 1023561 - protein, 91 aa, Homo sapiens
MQAMETPASYKRGYHWEWRRGKGEPTRRYVGNRYNHTDGRKSKRQRGAARDRREDKEVTPQHGGTHMVQAENTTQGRNDSMETQQNVEKNT

SEQ ID NO: 1023562 - protein, 301 aa, Homo sapiens
DGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQAGLLVLVPAGVGAAIELWNSEARHCTMTYFSDDGLLPELQYGTYSESDRKTEEYDTQAHERTCHTCCTLSVFGVAVYPPPEISHYKKLVLLVNQQLRQPGSMPWGILFMLTQVLVNYQVDVRVDILTWKASPNRAFQPPSWL

SEQ ID NO: 1023563 - protein, 176 aa, Homo sapiens
DGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLGRAGGPFLVLGPAGGLGPPI

SEQ ID NO: 1023564 - protein, 70 aa, Homo sapiens
MVPPSGEVEGLALGDGEDERITVRLGAGAVTGGEDERGELGACDRRRRDREWSDIHLTDRPLTVLRVGEG

SEQ ID NO: 1023565 - protein, 61 aa, Homo sapiens
CGRNKATSAMDSISEERSMAAIRQVASDSILIIVSHKLKTLATADEIIVLESGQLTERGPL

SEQ ID NO: 1023566 - protein, 285 aa, Homo sapiens
APLNSRRRGSSSPPAAPSGVDLRCCGPVSYPGVTAAAQSCLCGKFVLRPLRPCRRYSTSGSSGLTTGKIAGAGLLFVGGGIGGTILYANWDSHFRAKCTTKTIPYSDKILRNMGPGPVRVFIQCPMCHNDPRISSRVHYNISSVSEVLTNTSNTSLPHNLHKTQQGDTPASANSNLQKRLKLHLLQQRDTLSDPAPAVQPEESFTQLITPELGDRTTPPPATFSTEASSSFYKGERPPAEQVARSPFAQPGQHYAPTVKWQSSSPIASEACSEANWQVAPLQGIG

SEQ ID NO: 1023567 - protein, 359 aa, Homo sapiens
VVLHFRERRREIGCGREARPLRRRIRRVSEPSESHTNDSGGKSSTDAASIFDYRMRCILQDGRIFIGTFKGIVDKHIEFRSVCDCDEFRNDQAKRTPNKQKGTEKRVLGLVLLRGENLVSMTVEGPPPKDTGIARVPHCWSCRGPRDRQGCWQRNPSWGSHDPRLLQDLLGQSSGVGGPSPTGDDPTRKRYCCSRCRLLTTDSIAGGSKLSTHLGSGGTSPNYGTLEHTLPGMNGANFHGIESSYGYPNGDPPLEEGLQWRHATLRETAGNLPHSIATRPPPPDKIPPRQRAHNNALTETLHHDAPPARRTRNTAAAKHTNQSRHTEAADNTTRRTHTTNPKAHTGSNTTHTTRATDTQ

SEQ ID NO: 1023568 - protein, 109 aa, Homo sapiens
SVLGAAGAIEDVAGTMMIAASLTRVNRDEVLVRGDLVETLRFNSLISHHQAGPGGEAKVKLGRFGSRHWWPDNYTLYFMSAGCMGCDQEYKSSMDVKAAEKDSDSALQS

SEQ ID NO: 1023569 - protein, 73 aa, Homo sapiens
LLASVLRDEVIWNLDTTVDDKADVNCACVTHAGLNIVTGDDFGLADRSLTFPCHRTHFATHTNADTSGHSCSL

SEQ ID NO: 1023570 - protein, 295 aa, Homo sapiens
EGSMTQVYERLGEAAGSGGGGARAFGGRQLHPPFPAGELLRVQHWLEPTVWCCSMVTPLEAPSGASAHGSRAAAVEAPYQPVESDDESLVRPLCCPALLALDSKLPSGPSTPQGGRLSSGGHGRRIELGEWPRIPGPQSVEGPGPWQLCIIVVKRPTARIIINPALSRTMVHEAGSCYDGWVPWHSLQLLSSSSLPGLGLGTVTVHGARMTSDEFQELIVFSLGRSPKSGSHSSHGQKFSWCTESSATLPAVRVGAHARGGETGVWPCCSRLCGHRQAEWNLAPCQHLGATKVAS

SEQ ID NO: 1023571 - protein, 50 aa, Homo sapiens
FGLGISHGKWQYVTVPDVRGQALCACISGLCLTGAGPHIWNRLHTALSHE

SEQ ID NO: 1023572 - protein, 129 aa, Homo sapiens
ASCLYFLNALYFSTFILPQRFILLNALYFSTLNALYFLNALYFSKFYTILNALYFSTLYTSQRYIYFLNALYFLNALYFSKFYTSSTLYTSQRFILLNALYFLNALYFLNALYFLNALYFLNASYFLDV

SEQ ID NO: 1023573 - protein, 59 aa, Homo sapiens
PLNANRVRCHLASNAVCSTCGLFEETGLHILGDCPMAREVWNIIIHPSSLHAFYNSSLI

SEQ ID NO: 1023574 - protein, 37 aa, Homo sapiens
HGVAVTCGSSVLIPACILVECPLVPSGEGTSKKGLWA

SEQ ID NO: 1023575 - protein, 49 aa, Homo sapiens
GDLVGSPSLLAGHRSWGSQVRLRYPYSPWGLSVDGDVGDGQLREEIPKS

SEQ ID NO: 1023576 - protein, 116 aa, Homo sapiens
LLSASLCCLPRALVTLSLSLGSRIVGITSMSHVPRFQLLILDFYLTVFVPPPPLFLIVRLLFPGSFFPGGTMLKDRHSLVWFLWLYNIVIVLHVLTLPFVPGQMEIKHSAYPVVCW

SEQ ID NO: 1023577 - protein, 32 aa, Homo sapiens
MRGAALNHSARVKQCAAVYSSGGSDSGHCLDS

SEQ ID NO: 1023578 - protein, 52 aa, Homo sapiens
MADTADSRPKDKPPPPQHNNAKKPDKQPVPHRETDNEQIARTQQQTAARPTD

SEQ ID NO: 1023579 - protein, 282 aa, Homo sapiens
RSGSGCVVDAGLSGPAPRDGLQGKEAAVLLPTRQRPRGATEMRVARQSHFTILAGRDGVYYVVQAGLYSGAQCPPARLQSAGLPGVSTTLVHRHVEEPGGSSLGTAGNPAFGGSSEGCQRMGGQRVMCVSVQPPFPSGGWRMRRPRESSSTSKAGLRGCNQRLKQAGNVLRQRCELLQRAGEDLEREVAQMKPAALPAAAAASSGSTLGACRLGQRTSGLTPGFPWGSSAQNGIHGVQPTCVLTHGAAHELWAAVHRRLIPAELVGPPSCPVLVTCGPLGLE

SEQ ID NO: 1023580 - protein, 59 aa, Homo sapiens
AQDEDLIDLEETDDNNRAFSYKPLWKLLIDRDMNKIQLQERAGISPATLSKLGRGGNVT

SEQ ID NO: 1023581 - protein, 139 aa, Homo sapiens
MGLALLGVLGDLQAAPEAQVSVQTIFQQDKFLGRWFSAGLASNSSWLREKKAALSMCKSVVAPATDGGLNLTSSFLRKNQCETRTMLLQFRGPGYYSYRSLHLGSPFSVSVVEVDFYQYAPLFSQGSKCPGEDFRMAAL

SEQ ID NO: 1023582 - protein, 76 aa, Homo sapiens
CPVALGPGQSSWQIKAGRWEERKAWTQYQGETSNQACHGHLTLRIPFPRMPMKIVFRGSHTHRPKSDVTGVPRLEI

SEQ ID NO: 1023583 - protein, 73 aa, Homo sapiens
LTPVRCRTCLWRGPQRGTGQRWGEVHAQCRLEDASARYTGGLDEVQLAIIAITLWPEAISRAPVPTVPCTERS

SEQ ID NO: 1023584 - protein, 219 aa, Homo sapiens
TLLREEPATVDCETQCTVLLPATPGWTPCRDPPPFGPQASQGFLWTGLSLLIHSPASPRPPQLQVATSSRQSDEVPASALRGPSAHNSGDHGGDAAWGSWTGAPTPLLAWNDYVRSISRLAQHLPLCWTRPRARAKPRRIPTGQPRPAGRGRTCCVPARHQLNVSVDSSPTTATWADTVDPLALARVWGVPGTSSQAQRDLHKEELALCLASVGPLYDR

SEQ ID NO: 1023585 - protein, 43 aa, Homo sapiens
TVNFSISLKKMMSQYVVRKPFFIEGLSYNILADIIFFAGHSSR

SEQ ID NO: 1023586 - protein, 85 aa, Homo sapiens
YPVPCTVRHAPMNTQSGIPSKCTAGSLPMNTHVMAFLSKHTVRQPLDEHTCQASPSKRTVRQAPMNTQSGISQRTHRQASMNTQS

SEQ ID NO: 1023587 - protein, 40 aa, Homo sapiens
RLKICAGMGDDDEHEQGGEHAPSRCRGRRSWHSRMAVGEL

SEQ ID NO: 1023588 - protein, 68 aa, Homo sapiens
CTVHSIGYPKCLVCGEILESKYQHNFVSCNCKNQTFTDGGLVYNRVGAVDLDLVENLCEYAEMTRGEH

SEQ ID NO: 1023589 - protein, 77 aa, Homo sapiens
PVSLLAGASWPGALLSDGCLLRAGHSRCITARGTHPLAKKLPAQRTTRAVALSSSVMCSEARSRCGYGSSCCELRSG

SEQ ID NO: 1023590 - protein, 70 aa, Homo sapiens
DVSGNNSAWLGRLRETDALSMVAINKRSASLRKQTNLGPAFNTAAESRFLIPKTSERPETPEWSRSGYRP

SEQ ID NO: 1023591 - protein, 39 aa, Homo sapiens
SVALGTQGVTPAPGSALRASILQVILRGTVAKSRGVPWP

SEQ ID NO: 1023592 - protein, 65 aa, Homo sapiens
MLLDICHITSLAFIRDRPFCFSGLYRCVHVIKQLLIHLHKQVQAIIDQSMDCLVPVDSWRPCRDA

SEQ ID NO: 1023593 - protein, 100 aa, Homo sapiens
DLVKDSFACAKNWWLDDERRAHIRGMEGGRLGGRINSRPGAMLVSLYSSANFSRGNDHMSSECCNVTSSDQETQEGLGSPKEAIGAIPKRRRNRQRSPQH

SEQ ID NO: 1023594 - protein, 103 aa, Homo sapiens
CGNEGMGHEQNQGAALLQDVYHFVWLLTPLLGPSPESVLLTYVAMMTCYRSHIPVTSECTAMDGMSQMWDSLMAYDERLRLSLVLSTFAHESLWVSSPWPEIC

SEQ ID NO: 1023595 - protein, 208 aa, Homo sapiens
LSVGSSSPGGEAGGGGVMRSLLRGAVAGDARKLRVCFTSERRKDVLYEEIPRTRPLVISLFPKSVYEQEIPAHPGLAMFVEVKDPEDKVILARQYGSEGRFTLTSHTLVSTRSVFTPIPPKFSLFAVGMLRVHLDIQVGEHANDYAEIAAKDKLSELQATEVRQLVATSGADPRKSRTHPAVAKERFRRPVRAPTSGCCGGSHSGKTL

SEQ ID NO: 1023596 - protein, 186 aa, Homo sapiens
LSVGSSSPGGEAGGGGVMRSLLRGAVAGDARKLRVCFTSERRKDVLYEEIPRTRPLVISLFPKSVYEQEIPAHPGLAMFVEVKDPEDKVILARQYGSEGRFTSLPIPLRVHLDIQVGEHANDYAEIAAKDKLSELQATEVRQLVATSGADPRKSRTHPAVAKERFRRPVRAPTSGCCGGSHSGKTL

SEQ ID NO: 1023597 - protein, 244 aa, Homo sapiens
RGVLLPECRRRSCCCRSPASCPTMSSHLVEPPPDPCTTTTNNCEENEQSLAPPAGLNQFLGGATHEQQQWRMIMATGNTLAGLETRTIRTSIHPQLETWRRYFWMHNMNQDRDSIQRQFITCDTTFRTQERWAQIMSDVEMQQQQGPYDLKSEDKKLVEGEKDVEAFDTHKLRTGSQNWLQSTRQTFHAKAVPLQDTLNVLCSLTHEEKGSHDEQARLHSAEFLTLSNPISLPFLTVGLGASIS

SEQ ID NO: 1023598 - protein, 93 aa, Homo sapiens
MCATCDRRRNEETLIYCNEESAKVCRFQLEWVGTFALGFKLSENFMGTQEGQNRGDYYKAQTEVLEAFKPKASQEMRSLETPRDDSITPNVLS

SEQ ID NO: 1023599 - protein, 110 aa, Homo sapiens
MDQLLSQIGQENTEENRCSDRQVLISADDRVKKCIGGVIFYHETLYQKDDNGVPFVRTIQDKVISVGIKDDKGVVPLAGTDGETTTQGLDGLSERCAQYKKDGADFAKWR

SEQ ID NO: 1023600 - protein, 143 aa, Homo sapiens
LGIHLEGHTVLKIKHKRNCIDVIRMKTAWGREEYVLTYNYEGRGSPAGSVGCCSEKQEEDGLDFLNNLEPKFITLAEACTKREVALQLGLCQTFWRFPKIILVKFNFNMYVYDDFFLNFELCYSPIYIFKASWCLSFAKSEKL

SEQ ID NO: 1023601 - protein, 208 aa, Homo sapiens
SERLREHAYEHSLGQKLRATKQRAQEALLQLSQALSLMEIVKQGVDQKLVEGQEKLHLGCVLESCDTSKHASEGRRRKIRANARSGVELPWSLTYVPVTIAQSICQATCIAPWGPASSRASATNVKDHGAARPAVRWRTFHATFSRCYPVSSRTCPSQHSGPEPVSVSPAPARPWTTWWNMWPRTHLSRGIVGPFAPGITEKAPEEKK

SEQ ID NO: 1023602 - protein, 192 aa, Homo sapiens
HVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMASRGNINVILVQYKAVKETKVKELKRAKTVLTVIKWKGEKSKYPQGRFWKQLQVAMPVKKSPRRSSSDEQGLSYSSLKNV

SEQ ID NO: 1023603 - protein, 200 aa, Homo sapiens
PPGPTRKVGCSDGRACGAERWRRRLLWRPPCSCCVVRTRGRGLAPAWPKTELAKAGGGKHFNLLSSKGGDKSSNFLYLQVKGEVEAKVEELKFDRYSGFRPGVLVCDRQESRPGEWLVKKFFGSLPDSWARGHSVPVVTVGRAMLNNVGETKRQADGNCWENKAIHDLGGKRNGLSKAIDPTGRTWVFMCEPLPPNSANR

SEQ ID NO: 1023604 - protein, 183 aa, Homo sapiens
MLMKREDSSGKQTTVVNLVLSTVAGIISFFFHRVSVIIWLLSLPLIKVHENGSGEGKLLNVCSNYKVANGWLKKKRQRSNEQTQRTHEGQEPIRPATRKRPSRDRTLSVEEQGRHTKKENHDQPMGVTKTQRAPKRETHLGQQQNTRAKRNYAPNETTRRRETPRGRAEQTEPREEEYYRENQ

SEQ ID NO: 1023605 - protein, 78 aa, Homo sapiens
MCSAPEPGHSKRNHPKKKSFKAQGSEGCAQQPYFGAVNPELFIKPNKPVMAVRMGNSFTGGGDAWLLPFAIGRAIRRT

SEQ ID NO: 1023606 - protein, 42 aa, Homo sapiens
RPIQPFKFPFQKQRLRPCHSYVLLKIVYIGKRMLKARIFKIV

SEQ ID NO: 1023607 - protein, 190 aa, Homo sapiens
DAPSLAPALGELCHHVGPGCLPHPVRDSGLVLHPYILSSDCGRAGSARSHSQPWQVLVASRGPCSLRRVFWCTPEWVPHMLPTASWNQSRDLAGFGPALCHPEDTWPGISGQPQLPTPRIYDMSLLKNRYLRPGDDSRHELMLLRLSEPAELTDAVKVMDLPTTLVLLSVVDHFNRIGKVGNQKRVAVCF

SEQ ID NO: 1023608 - protein, 68 aa, Homo sapiens
ITAATTAPVITAPKRTRPAMMPTIPIVGIIAGLVLFGAMFAGAVVAAVRWRRKSSYRTGGSYSQAARQ

SEQ ID NO: 1023609 - protein, 104 aa, Homo sapiens
LCVHNKEGSPGCREPQVENNNEQLLYEQLLETANHKQPAGTMHLIPHVAPFSRTLSNFPPALASLQVAPSLLSCPLQHIFTISLINLPFFTYNYLGRWLYHLQN

SEQ ID NO: 1023610 - protein, 211 aa, Homo sapiens
REDLALKRPFFERPGPYSMPLSARDLFANPLPGPMPVLVPRGTCWHAIVQGQVPPLTLLPPWCPVTPPGALEPLCDSASVRLGGCHQPLPPRPEPEYGHPGPMEIHFKRAYPFPHSTHPPTFPRGKFTSELYPQKDGYSTEATGGPHGLRWGALLRRYSLPPPPMYPPLLPLRAFPTVSALGGEHVAAIRQRMSRSYPTLPGPTSLHPSPL

SEQ ID NO: 1023611 - protein, 84 aa, Homo sapiens
MPAALLTCGVVLTNAASEVGPQSARSSDEVLLCAVASDQAPLTRGASVLLRAFLRRLRPEPSHCPQAHTQNLTRTQNQAHTQTV

SEQ ID NO: 1023612 - protein, 64 aa, Homo sapiens
MQPNYCKAPTFNFRESGTSIGGEWVSVCLNGDEILLDLSTLHVSKESMQSDMVIPNSGSKMTGI

SEQ ID NO: 1023613 - protein, 182 aa, Homo sapiens
RERRCQCQALTKPGDSGGRGAFIPADRATSRWQPRHLTARLRGFYASFSHIKMGMKFSLDPYRWYPCVFSCANRVMQILSHNWSELISHFVSQAATGEEHFVFNKVVNLHVRVNDSEIGVMLTGRTWVPRCELHKTANSKLGWIYEFATEDSQRYKEGRVILERALVRESEGFEEHVPSDNS

SEQ ID NO: 1023614 - protein, 79 aa, Homo sapiens
RPPDSFGRRDSFGRRDSFGRRDSFGRRDSFGRRDSFRRRDSSAAGIPSAAGIPTDSLVKEGIAASFAVKLFKAWMAEKD

SEQ ID NO: 1023615 - protein, 248 aa, Homo sapiens
GAGRRERLVAGFSRPGPARPRRGGYQGGCGARARAQDTRGLSGAVGQALSRPPRGPVQAQAFQGCSAGRVREGLSGGPGAPHPLLPTWDSRGRPALAPLASVGLPGPLAALSRAGAPPWAAPLTPAVGLVRASVSDSAPACVGGSQDSRATGPFLWFVSVPQQHVGTFHRQPLGSPGHSCSVPWPSPGQAKVGQSWAASTPACMSPEQLPIGPLLAWGLQDAGRRELGGRAFELTPGGSSQRFPPSGT

SEQ ID NO: 1023616 - protein, 41 aa, Homo sapiens
GTLICIMVQLFEKGYGTDAAGIAMEAIAFARNQGFDVVLVD

SEQ ID NO: 1023617 - protein, 122 aa, Homo sapiens
RHVKTGGNGVMCSLKMEPSNIKERGLEEILPHSPQKELALWTPFQTSGLLSYRESIPVLLSPPICGSLSQRPQEANALSSAVQLWHLTGPLSRDGVKSFSYRMILMQRFRHKCQATQKRRVL

SEQ ID NO: 1023618 - protein, 32 aa, Homo sapiens
MMHSMSAIGWMETTLFFPMVWARNFGLKQVEN

SEQ ID NO: 1023619 - protein, 214 aa, Homo sapiens
GGKLAGLQPGGGPGPWCSARSKPPVPEEVGQGRAGLSAAWRERRPPRGPCGPGSRDRAAHVSAWRGPERKWRSSAPQPQPQPPAPFPLRQLPPSRARFSPRGLGPCASEAGHGDTEARRSPPSTPQTRSPGCDRSESPAEQWGTPQRQTAAPCPPKNHGIGKHGKLDEQDLPYPDEDTLTVIVRFGGTVRDRGPWGIAPEESRTVLPLFDGPGK

SEQ ID NO: 1023620 - protein, 122 aa, Homo sapiens
RSLMNVGEVSSPFLPYQCAPHTYSFTLFLLPPSIHLTKRHNLKLSYMLCYFLTKVPSTLPPSLHIPSEEHSQGRTGIIAIIPSIYLNPFSISSIPSINPIHPSNPSIHLIHPSHPSHPLSPS

SEQ ID NO: 1023621 - protein, 237 aa, Homo sapiens
ASTAFPGCPAASPRSLSSSSRAPAQLGSPRTEALGAPRTRGTPAAPGQPPAGAPSHLHAPSGPAPHPPRLCPQAQGLASKTQNPPGSPGDAPARQVARRWRKPQKRPLRNTGHHATGQTPIRQEETSYKQDEHGQTFRRNRNAGKVTFTTTPCTRAVSNLIRRHRRIRTVRGLGRVSWDAFTSWKPGVTFTRVSTAIEGLGVTVWLAGNYDRGDTSAETYFHPIIYDNKDLHQGIPQ

SEQ ID NO: 1023622 - protein, 73 aa, Homo sapiens
LRQKGNSNNSVKIYRNLEEFQKHMKNEALQKLWPQMFIELARDAVIEIRNKNSYMKLCLQQITDQKQKWPLVT

SEQ ID NO: 1023623 - protein, 167 aa, Homo sapiens
LIAGCDVYTRDYKTPATCVRTRRALFVTGTGVAGATVVLMQSYKPENILATTTVDGYGRWATQVDNPLPISPPDFTMTGYQSYFEGKRSGWLANRTIQVVDAPDLAIIETPAQGVENRTSASCCQVVVLRARPVVLLKSGDPYNAFVDPPLSMAIGRLVCAGGTELE

SEQ ID NO: 1023624 - protein, 35 aa, Homo sapiens
MPTHKQRHGQPFFELTHGVADGRRYTVQFLGGGAE

SEQ ID NO: 1023625 - protein, 45 aa, Homo sapiens
RTPLSPTQEHLWLCFTYFFYVIDQGETDVYVNNEWATSVGVGGER

SEQ ID NO: 1023626 - protein, 41 aa, Homo sapiens
TLLSREHLVTILSAAGLTPLDDDLWHQFSHRVDSSIHRDLI

SEQ ID NO: 1023627 - protein, 291 aa, Homo sapiens
MSQLAAAIPPQNDGTFIGYKERRRMWTNVSAPLNNFSVSADAMMMKTERARTKTFIILLACKWIHMSIERTFHVETPEEREEWTTAIQTVADGLKKQEEAGDGLPVWAHPVTTQELTEMEVSLAKPKHQRDHERGSEIPVTSAGLWLLSAKVTPGEGDMGTGRVLQPVKILKTGSHRWPRHEGEPTQSPENRVLETLQGTRVSSHGLKVLLARHHESPLAIVMDVRQEEGELYFHLIRERVFSEGPVPDFYGAEIVSALDYMHSEKERSCTGNSKLENLMLGQGRAHKDHR

SEQ ID NO: 1023628 - protein, 201 aa, Homo sapiens
MLQKSGIELRTCEPLSSRDVLELLLNNFCSAMSAGSRCSPGSMRRSPCLTSAADAPVFQGLSLVSHAAWGGSGPGLQVLPVQAQGAESKAQNTKATPGSYGSSQGKFTLVHLCDQTFQNHQEQRATLLQLALGIGSNLEATSSRTKPSPCTALGLSNTARAPPGRLFPSLLGTQTDLTLRQVQEDLARHTGIGDEGYIGAS

SEQ ID NO: 1023629 - protein, 211 aa, Homo sapiens
MDLSSKRKEETRWQISLKPKIACEAIIRRNKNRHKNRGKERKDKKGANCDRLTASLTTHLNWKQNVPKIAKELGFQPESGGCENSSVKECDDWRADGCLPSIVHPNPLERPIKMGWLKKQRSIVKNWQQRYFVLRAQQLYYYKDERGHEGPRAACIYPADVTHHGRIRHKPRKKPGTDCLWKSIPASWDQNPLGQDSYVLMASSQAEMEEW

SEQ ID NO: 1023630 - protein, 121 aa, Homo sapiens
MTGEQMAAFHPSSTPNPLERPIKMGWLKKQRSIVKNWQQRYFVLRAQQLYYYKDERGHEGPRAACIYPADVTHHGRIRHKPRKKPGTDCLWKSIPASWDQNPLGQDSYVLMASSQAEMEEW

SEQ ID NO: 1023631 - protein, 41 aa, Homo sapiens
MRECMGFPISSWRDAQTCIFDISVLQPFLGRCSATATSSSS

SEQ ID NO: 1023632 - protein, 123 aa, Homo sapiens
LRGSATVDLAGRWFVTHHDRQDHHFHQYRGEGQDHGAVGVADFFRQLFGVMGHAHRRHHDKRDQRKAGQQRNQLAAVEHPVLQRVGGDGGNQRQQHEFFLLEGCEHSGPFRTANQSLMEIYRW

SEQ ID NO: 1023633 - protein, 68 aa, Homo sapiens
SIASVHYRRALGRANVFQLERMDESDDGDATTGTAQILKARTAFDPPTSHSAMDKMWRNGKRVRRVKL

SEQ ID NO: 1023634 - protein, 310 aa, Homo sapiens
GSAGRTYLVRCEPANSLQACSAGPEPGGSRVRDSSPHGPSFAEGAMSHPADRHAGVPEEGCRARALLDKGRQTSRNVQIIFCTGIFGRQNITFNSHRQDLGTSRQASRDADGGIARNTQDDRTPQTQTMRHTRSHRARELKEPIMPPAWDLVPLTSIRYGTQTMRQDKKGNDAWTLTEGQQLVATSHYDCRLISHSGNSTECLTNIKKTICGKTMRGHRTSQDELEPEPDGPNTLTAMKQTPEQDSPGKWDVTASTLSRINSDKGKQGRSARTGEPKHDQTQSKEHNRGTQQDRKQTHDQKQSQTEAPSK

SEQ ID NO: 1023635 - protein, 77 aa, Homo sapiens
MQLPRINGGQGTLAMEPLSCPQAWALVLPLQSVRMAQQHWDGTHDHAMACWATNMSARSLVGNGLICWYEYQAPVAK

SEQ ID NO: 1023636 - protein, 79 aa, Homo sapiens
LIIPSDPFWVPTTEEEYLHFGEKADSQRGRREYMNLLKRKGLYVEEKIVEHAEKQGHSAKISSYLLLVDSFPYSEFKST

SEQ ID NO: 1023637 - protein, 46 aa, Homo sapiens
MNSQVNANVVHESEAQRQHARVKIPAKLRFFGADQTPMEVLRILAW

SEQ ID NO: 1023638 - protein, 262 aa, Homo sapiens
DHSVTVDRFGDDEAYMKKTVRLEMERNHERYVFLKWGKQAFSRFSVVPPGTGICHQVNLEYLGKAVWSELQDGEWIAYPDTLVGTDSHTTMINGLGVLGLGAYGGHRQQKPQLLGQPVSMLTPGCSGLQTYRKITLKVLPPQTWYLTVTQMLRKHGVVSDNSLDILLVDWSGSHYRWRIAPPYANNGRQQSGSHLVGFIPNRLLYNLRLTCSSTAAAQHERSRSKLAHRTNIMPKATGAIVAVTPGDRTTSKQAPYRPGIEC

SEQ ID NO: 1023639 - protein, 419 aa, Homo sapiens
MIEQHKRRGPRGWRWSRSLRGSMLSAVGERGSGPGDRAVEHGDAGRPCCERVPPHMSSASKTPVMAVSRGAVIGEVYLSAIIHPKGSTLASAGFDRLILLWNVYGDCDNYATLKGHSGDNVMELHYNDEMAVCFSQPSTDKTVAVWDSETGERVKRLKGRYFLCEFLLIQPMRGPRAFVWYLASSTDAHEVKPSGTSRERHAIPSEHISEPLYQVSQHVTPSNDTNVIHDSFLVEIDNDIKVWDLRQNKLIYTMIGHAMIQVTGADVEVRRDGSYLLSNATGHIQFVSGMSWPVCPRNERCVKIFQRECATFEKNLLRCSWSPDGKQYSSWLSRQVRLCVGYPRRAYGFTLAAMLLLKDWVPPCEPYYSFGAPLFGEIAPMWRPACLTHRCACGSPPNRSHGALPLSVAVPRVLYAGSY

SEQ ID NO: 1023640 - protein, 175 aa, Homo sapiens
YGEGSSLSASINEALNNNGILYSVGKFSTVNPVYVGNVALAHILLRLPKTSIRGFYYISDDTPHQSYLNYTLKEFGLRLDSRWSFPLSLMYWIGFLLEIVSFLLSPIYTYRPPFNGHIVTLYNSVFTFSYKQALSRTICAYYSSLYQLRAANAMVSKTVEVGLVSLCETGLQGDT

SEQ ID NO: 1023641 - protein, 107 aa, Homo sapiens
DPTFSDMVRPDPHTHPRSYLCRHGQTQILILMPDPTSSDMGRHRSSYQGQILPLHTMTDPDLHAYNRFLPSQTWRDPDTHTCTRFLPSQILTDSDPHTRARSYLLRY

SEQ ID NO: 1023642 - protein, 236 aa, Homo sapiens
MACRGEYWRSPRGKQGGGGLWGRAGPIISTPVLVVSDAVVLSKMGILPVWSRAREDSESLNLWPNKEKDRIYEHVEKEEGTRQRNFSKGDIDNIKRGKMGNPQKDREAGLSRRNKEKGCIYHKPGHQEINKQHCTNRKDTKRTTGNEKKEGREGQAQDTKRSMEDPCQGKGNSQSRERDQQGERGQSTDTRRGPSTEEEIRRTRRQKQRSTHRTKTKTKTEKGGEHGKARRAPTLD

SEQ ID NO: 1023643 - protein, 68 aa, Homo sapiens
KQLEAIKQLQEDAVNQEGILRKRLQETSQRTGGCGGAGRVAHGYIRFRGHLLRCPANHEIKMEEEQTN

SEQ ID NO: 1023644 - protein, 101 aa, Homo sapiens
MPAWLAMIWLNIWAWLSNLPINAALLSNEVSCCWALNAAINSSRLLSKTATCSGWVAMACRPLQALHHTGFQGADPSLQVCCFSGLAEGGIDLYLVVRLGL

SEQ ID NO: 1023645 - protein, 125 aa, Homo sapiens
TAQCCESTGRAIITCQVIFLVLFIRRQSLALSFRLEYSGAISAHRSLHLPGSSSSPASTSRVTGITGVCHHTRLIFLFLVETGFHHVGQAGLELLTSGDPPTSASQSTGIIGVSHGIQPHPSFNQ

SEQ ID NO: 1023646 - protein, 358 aa, Homo sapiens
MDYLDPRSGNSFERILTRLLLTPGHGYNRIITQKELPSDAENTRRHNTGRPDPTQQRTSVRDHSGAPRPLRNPTVISSRAYTLTHNTVATQNKTRTPKSPLCFYVRGWNDYLLGASFSGTYSNRSLDIARLSASPHSVPFLTVTRSTIWLPHSFQLSYSRNPSSNNSQELFAATTSSVSDGLTRIIFLASFPPVTLSSSSLSSECTNSTTWRTCSQRLFRILRYSERTTPRLIITISRSPPVFGCVVPCGSQPSSFSLGMLNAGPSAAHVPALVSREPSVPRPHRHPDAIWRARQRGSSPTSAGHRRATEPSCDEATDSETNPPHEEPTKATAHRRSDDTTARKPRERPEENTQSNQP

SEQ ID NO: 1023647 - protein, 234 aa, Homo sapiens
SGLRAPRLQPSARSRFRCHCLLPRAVRRLPPQARGSVRLGPLLLAPGQENELEEDAWDPVQGSPSLPQLWRGRKLELEMPIWSECRTRSRADPGEARPARPTGAMGRSGRRCLTPAVRARLETCHGQCPCRGSRVTLVAPEEMWRGSSGTTLPEPSVQCKLLSDPDARAVAMVMSQGTYTFPHVLRRLLAHLGSHRPALLPSADFLSRPHSNAPGGATCASRNLSALELEPSEL

SEQ ID NO: 1023648 - protein, 106 aa, Homo sapiens
MFGKTADAWLQDLLNWCMQIGQGMSYLEDVRLVHRDLAARNVLVKSPHHVQITDFGLARLLDIDETEYHADRGKVPIKWIALESILRRRFTHQSDVWSYGVTVWEL

SEQ ID NO: 1023649 - protein, 81 aa, Homo sapiens
LLILQVGDSEVEGEWHQERARGCVAREGGWSPRGFQVHCRGPRNTGGWHRAPMGEAIDIETVPVQGVGAQLCNAVGQLAQV

SEQ ID NO: 1023650 - protein, 102 aa, Homo sapiens
LLTICMSSFEKFFVMKSISSHVTIPGETTKEKSMHEHHCFYLMNSKKDLKKGLFHSIGATFENSVKLGADISLLAHRSTISPESLGHTSRKEICHSMQVLKS

SEQ ID NO: 1023651 - protein, 135 aa, Homo sapiens
ISGDDTCPGSPALWVTRWVLLVHRWPCRSFHYNPGQSEAFHLESSRYFSTEMTYLLWPLVAEPLEDPWAPEFRAIQRGSSGWHHSSARPFQCGREPRELITSGQNWMNGDSALLAGFHCGIMRHPDSQCSQTVTR

SEQ ID NO: 1023652 - protein, 246 aa, Homo sapiens
NVLVCVNRTSAQQPLQVYDFWCDAGVEFIQFIPVVERLADETTARDGLKLHAPGDIQGELTEWSVRPEEFGEFLVAIFDHWIKRDVGKIFVMNIEWAFANFVGAPGAVCHHQPTCGRSVIVEHNGDVYACDHYVYPQYRLGNMHQQTIAEMIDSPQQQAFGEDKFKQLPAQCRSCNVLKACWGGCRNTVHARCQRQTGTELFVCRVSALFPHLPAYLKAMADSAGARSPGQRHYACAFVVVSSRNR

SEQ ID NO: 1023653 - protein, 50 aa, Homo sapiens
MHGVKNQSKADADPTISIVTLDVNGVNNPIKSRHRPNYINRTIRCDWSEQ

SEQ ID NO: 1023654 - protein, 70 aa, Homo sapiens
VLNQNSDIPGAMADLAGCCKHSQWRKYTGGAEPRAMSPHILFFMAAQLSLSPQELDKIIDKMASIGATIK

SEQ ID NO: 1023655 - protein, 95 aa, Homo sapiens
YELDGFLGIDVMRHVAQVSSQGYLLIPNSLNDTHMLLLTGRTWKGAILVGFKRGDRKPKLVADFMAKKFSLDALITHVLPFEKINEGFDLLHSVF

SEQ ID NO: 1023656 - protein, 313 aa, Homo sapiens
MDDKAFTKELDQWVEQLNRAVSTVNENQAADAVRARQKEILTKESNVQGGSLPCLLSVEMCSGHTFMILLELFRIGWTDITRIQIYFIHWRDYCYDRGYFIQVETVTLLVAINTRAVTPETHLSIIDAGDNHRKPTNYPKLLLASMTELSADKLLGNANAFGTYFTDLFDYLPLTALVDGPQIFCLHGGLSPSIDTLDHITAWIVYRTVPPCRGPLCDLSSVRSRIDRACLAVFPPVLLAPFSAPPLLTFTLPWSHHWLPRAHPACTARIPLGRPASPSSAPPPAAPTSWYRCAHPAASVPRCPSHSPSAVGP

SEQ ID NO: 1023657 - protein, 84 aa, Homo sapiens
ATTIDLYQSHWDDPENAVEDVLGTYQELIKAGKVRAIGASNLTPERLTESLDVAKKHGLAALVKPCSRLYNLYDRSAFEDGLEA

SEQ ID NO: 1023658 - protein, 313 aa, Homo sapiens
GSPATRPGLDGRAAGLGRGGAEGGGRAQGRARLCLASRSGSSRAAASRGSERLPRGSVASAGAAGALAMRTLWMALCALSRLWPGAQAGCAEAGRCCPGRDPACFARGWRLDRVYGTCFCDQACRFTGDCCFDYDRGVPSSPVLRGGMEPLEWLCRPVQAYNPCAEALGAAGASERRGALAHPWKRELAAWSTPTRRGQDCGHTYVPAFITTSCIQQGENTTSYVSTLVYTHQRMLDTGMGSLETEVFDFLNCDSCENLCPWTRWDAVSPERDTRVCVDCQPPAMNSVSAFCSSGDGLDVLMEMQTLHWVSNW

SEQ ID NO: 1023659 - protein, 248 aa, Homo sapiens
EQLRGGVLDFLVLWAPWQLNSSVKLDEDYIQDKGESYLDSMSMVPHYRQALDMILDLEPDEELEDNPNQSDLIEQAAREMLYGLIHARYIRYQTVASSTDRLEKYQQGDYRLLVSQLCYYVEKPTLNSLPNLALSQNMHRGRSTVDEKTATCHQVHRMCTHHKSSRHHHTDGAYIRQLVFPHMLIHGASRVPAQETCQPVYVPQALQVFKIHARWRYTVLQIQAQPATSRAHVKTMSVIPSPTVSCSL

SEQ ID NO: 1023660 - protein, 57 aa, Homo sapiens
CTLMLWSYLEYPRAYLDLLAYLDLLAYLDLLAYLDLLAYLDLLASPEVIQVCQMAQV

SEQ ID NO: 1023661 - protein, 106 aa, Homo sapiens
REGELIISFLRPLYEEKQKEHIHIGEMKQTSQMAAENIGSELPPSATRFRLDMLKNKAKRSLTESLESILSRGNKARGLQEHSISVDLDSFLSRTLKNTSKEPSVC

SEQ ID NO: 1023662 - protein, 45 aa, Homo sapiens
MGRNFSVTNARTLFTAHRYPCNVVHRLFSHGPHFVVRLLIRPSYS

SEQ ID NO: 1023663 - protein, 356 aa, Homo sapiens
RAGRRQAAPQSGGSSGGSRKPLGRTGGPGGAGGGEAGGRHRPGRQKSLQFSRLQGKSRRPAKPPSRAAEPSRSPAAVPGGPMPRCPAGAMDEGPVDLRTRPKAAGLPGAALPSASARCARPPRSPPVPAALRALSSPWTLCAAVRPAGGPRGPPTAWPGRRRFTTPELTDFVPHSGHGLPVSSGEPGYTHITHDVAPMEQPHYMLNIAMANVTDEEGGHSLSHIAVVQGTMQVCNGGKLLPAVGPGAPHSKTTTGDTVPPGWDNALTVRSQAMGYGGAMPMWAERDGQKGATGVEHGPLAGTRGKTPALARGQNNRTPRRRHGETRVEGENKRQRIQDGDRRRKNAHTASSTQMKS

SEQ ID NO: 1023664 - protein, 55 aa, Homo sapiens
LEDPELSRVGVADSSLVRWPPDLLLVRGGMAIFSHSFLIMPHGPTPILGGELLAR

SEQ ID NO: 1023665 - protein, 289 aa, Homo sapiens
HASPTRPLGTRALLGAPELSHPDTIIPKTPALLPWQATCPPKATPLRPHLPTLSPLGTRSRRYILGPGRRQCPTQVPAPAPGFASLPLAQSPLALGVCCPLLATARGAFWPRTFLVPALDSRISDYTHERLSRVETVPRLGKTPVTRAMKLRLLGPGKPPGSGGRGEQMLRPVCAVDARQGPLTMIQPGRPRETCRCCSRLPTAATVAARVLPPVAIQEMEVQAPAGTSIGHVLQTLDIPSSPSSPSRMPSRQNSLAKWWGLLDLWLWHRHQTLSVKTRDESRQCGPIQ

SEQ ID NO: 1023666 - protein, 112 aa, Homo sapiens
TLARYPAASIAPPTTPEIAETTEPAAPWIPCTRPAMICEPIETICPAIPVMVLMICEPILINEAMTLCTPAVTALRKLDIAALTAETTDEKILDTVESTLESTLETTLSTAW

SEQ ID NO: 1023667 - protein, 110 aa, Homo sapiens
MEPFLLIRTPRPVIVEPLVQLDDEDGLPEKSCPEESNVSKGERNPSSFCPALALFEYGYFNSRLEGPLDEIGKPSKGDQVEKTMKDAKDKLEVKWKMPIMNIRQIFCAKI

SEQ ID NO: 1023668 - protein, 96 aa, Homo sapiens
APVDRSAPVDRSAPVDRSAPVDRSAAVDRSAPVDRSNTGNLTRPGTGQAWHRWISSYSHSVGGGAIAVLQWVAAIGLVNSDNATHIWHAQLVTRTP

SEQ ID NO: 1023669 - protein, 59 aa, Homo sapiens
MAWRGPFPKPSVQGRAPGNSPPPTSASLTHHGTGLQSFSGYPGAAEMETQGRLWNLLKL

SEQ ID NO: 1023670 - protein, 159 aa, Homo sapiens
MTGAPPTPPRALERNVHDIRRASSPRRHRPRDDNFDAIYQRPAQPSLIRPAGRVRTSAPPLAHSPHHPRTFFFPPSIPIPSPFVPRFPPQAPFPYSRTALLHPQHLQSHEPLGACATSSRSISNHDVPIPTQLSHTIAIRSTLPRYILSPSRVPLARPR

SEQ ID NO: 1023671 - protein, 46 aa, Homo sapiens
PRLDRPPIPTHLNITDEVVGKKRVVGKKRVVGKKRVVGKKRVVGKK

SEQ ID NO: 1023672 - protein, 49 aa, Homo sapiens
ALENYGYCDLRTYGLRTDVGHDTTRRRTRTTFTLLAFWRLTVTDWTSGR

SEQ ID NO: 1023673 - protein, 118 aa, Homo sapiens
RKATAQHGAAQLLLAFPFAGREVSMGHPLPPTLPPTTLPAATVDHSQRICDRLGLQTWMKETERNIRSKLSDNNIHLRCYGTTGGFQGCGLQGPNWDAYSRSNCWLIITIYGGVLSTC

SEQ ID NO: 1023674 - protein, 104 aa, Homo sapiens
MKQNLQIKYNIFDALASRLPCALTMPAATVDHSQRICDRLGLQTWMKETERKVRSKLSGNNIHPRCYGTTGGFQGVVCKDPIGSKFKEQCCLIITIYGGVLSTC

SEQ ID NO: 1023675 - protein, 61 aa, Homo sapiens
EIQTVPESKQCPESKQCPESKQCPLGAVVKGCTSHYDAVVNSASSGVLSAGLNSGVLGRYA

SEQ ID NO: 1023676 - protein, 54 aa, Homo sapiens
FQRRSDAYNACSDCINAALTASNAALTASNAALTASNAASGFGDLNPEWRRWMQ

SEQ ID NO: 1023677 - protein, 54 aa, Homo sapiens
MCILVLVLFYTLLSKDIPEDWVIYKKRFNGLSSSTLAEEQASQSATVNAETNVT

SEQ ID NO: 1023678 - protein, 76 aa, Homo sapiens
DASSLYYVLDGPLLGIRQLWSRPSPPLSSPGLRSQPPNLDSLPCSLSQIQLLRTAARARALKHRPERVTVPLGRSC

SEQ ID NO: 1023679 - protein, 42 aa, Homo sapiens
MSAGKMVISRLWLDVCGCDREKSRSKRDEENAIRDFSPRLLR

SEQ ID NO: 1023680 - protein, 69 aa, Homo sapiens
NQVYQRKLPLRTGLSIMFVLGRIENHGSELCLAVRLSFLQGRDDSSRYHVVKIVVRECLYRYLYITCIP

SEQ ID NO: 1023681 - protein, 152 aa, Homo sapiens
MGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRAWGPARLGSFSRQLKEQNG

SEQ ID NO: 1023682 - protein, 176 aa, Homo sapiens
MGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRAWGPARLDGISLCCQAEVQWHHLNSLQPPTPGFKPFSWPQPPE

SEQ ID NO: 1023683 - protein, 108 aa, Homo sapiens
QVTVSRRATPMQVNKHHLVSRFIFQTAERAEWLNKTVKHMWPFICQFIEKLFRETIEPAVRGANTHLSTFSFTKVDVGQQPLRINGVKVYTENVDKRQIIYGPSALVS

SEQ ID NO: 1023684 - protein, 164 aa, Homo sapiens
MGRVAHHRLRRQEEQSHCSGSRHHSRSLGSVGPATSQILPKPPHNSSAALENSGTRRRPDRQASQHSISNTPAMEDLEQLTLVSIIGQPSTGRRHRVQVPVREGARGRGGRKRRRKRRTEDEDLEEHGGAGRGEPAERRSMSRQDPSRTKRHMKEQRAARKDGE

SEQ ID NO: 1023685 - protein, 45 aa, Homo sapiens
MSGKNIYHSIAKDEHGAGAGGSRLVISQYFGRPRRVDGGIEWYGG

SEQ ID NO: 1023686 - protein, 74 aa, Homo sapiens
RTLRAEVRSRLPTLSAGVTSRWKLAEDPEGRDEVPPSHAVSRRHSGTVMLSEHVSKPTECRTPRVNPNVNMDFG

SEQ ID NO: 1023687 - protein, 80 aa, Homo sapiens
GQADLDKGAGNYLENRLCAVIGHSAYPMDPGYPILGINPRGTSYMYTLEMVYQNIHSHPIHQSQSLEITPMPMEPESGPV

SEQ ID NO: 1023688 - protein, 74 aa, Homo sapiens
NSYDHSAGQVNHRAEIYQYRSVVNVQGATQHRPTYELMENPDFEGKVDDLYPLQSDLSVLLSGPWSVYNKDVHV

SEQ ID NO: 1023689 - protein, 120 aa, Homo sapiens
SSQHFIVTPTAVQGANVHMIMANSSKLNLQARFLLQLRLKVQLPTNTCKERLNEKTNFPAQAPASLSLTISTSVLSRFLEVYHTQNFPLQGLCMCCPLSMGDSVPQFVSKLAASHIPKIS

SEQ ID NO: 1023690 - protein, 36 aa, Homo sapiens
MTSYSYLQSSATSSLRRPGRRAPCVGPGGLLFRAPQ

SEQ ID NO: 1023691 - protein, 141 aa, Homo sapiens
LRTPDGRYRDLIFWRRELDKYRLAGISTVHQLADADCGDASIMAYAYMQGWTAVYRPDKVRQRRNRAHGNTVDENTARVNGVRTDRARSDADIVRRADVEIDVDMEAYLERGCYLWGIWDGATYRPFVTWQQLNSDAEARN

SEQ ID NO: 1023692 - protein, 358 aa, Homo sapiens; identical to SEQ ID NO: 839491

SEQ ID NO: 1023693 - protein, 313 aa, Homo sapiens
AQLEARVLMMSTNNILSPANGKPIIVPSQDMVLGLYYLSMMKEGEPGEGMLLGDMAEVHQALNAGAVTLHTKIISRVPQTDENGKQYLKRYETTPGRMLLGETLPHSHKVPFETVNRLLTKKDVGDVIDEVYRHTGQKETVLFADAIMALGFRHAFRAGISFGKDDMIIAPDKDKLVDETRDQVKDFEQQYQDGLITQQEKYNKVIDAWSRCGDQVANSMMNEIKAVRHYEDGADEGPEKDINSIYMDGPLGCPRFAGADQAARRHARLMAKQAGEIIETPIISNFKEAWRPDISIDQGPEARGHRVRRGNRE

SEQ ID NO: 1023694 - protein, 105 aa, Homo sapiens
GQGSESPPTKQASPESTMGGALPEGVRALDPSEPGQGDPWKPGGHLGLMQVGMCMSGADRVGANRGQRSLLGLPRPPPRRITAKCPCHLSARGQVSARMRNAHVN

SEQ ID NO: 1023695 - protein, 174 aa, Homo sapiens
PRGEVVIVHLGAMPVQGSRLLDRVQVFGRKEDMRQLWRHCKRRRMVVIKVNGRTLADDWMQLHAYQYNAAGAMLPASRARSEYAGRRHPCPLLTWVVVTVAPDLCYPIISISKDPGGTITRNYVGVRLPRRSIRKTSSSSMDLDPAGRLSLVAAEVHRKFGGPGARARYQKSYR

SEQ ID NO: 1023696 - protein, 66 aa, Homo sapiens
VTSETSVAPYVLRLAMTSYSYCQSSATYVLRRLSGGSVRFGPGVAYRAPSIHGGSGGRRRIRVLRP

SEQ ID NO: 1023697 - protein, 53 aa, Homo sapiens
MQARVLSQRLAIHHMITQDFFDTAYSFRCVGFIKKNRWCPTDVGPSWRRPFFS

SEQ ID NO: 1023698 - protein, 43 aa, Homo sapiens
GRLLLLLLLEFKLLTMYGDMFIHLSPILLLSLNPDIITGFSSQ

SEQ ID NO: 1023699 - protein, 275 aa, Homo sapiens
EVKLSVKFNMQEMFSLNEDAGPDKTVAVGTSEMSSICCVSHNEQTMVQRMPLLSLRHVAVEGRLLSCRVHESEVWSIYRVYGVATDIQVTEVLLLTVNNKDVSVMMSEMEVNAHLDGTLKLYFRDDCPEPLFTDEFYPNFAEGIALSDPVAKESCMLNLLLSLPEANLLTFLFLLDHLKRVAEKEAVNKMSLHNLCHGLWPHCCSWPSEKESQAPLPNPSQPIHHDWQLVLGRSCPRVQVLLYFLQLEAIPGHGQQETEHPVLHRSLKGPRSISW

SEQ ID NO: 1023700 - protein, 168 aa, Homo sapiens
MKKDIFGHGSRRGLMCPSSVASKSRSSFPQELMCIEEFWRIRRFEVEMKENVPHKGNICKHQLNSMPTVLGQKNCQGRNYALPAPSSLIAYYMKEETLKKPKQTPLDKKTQLAIYHSILRGKSSFSQSLFPRNCEKVQSCWMKKPVHQGLLPVSCALYQPKLSVPTWP

SEQ ID NO: 1023701 - protein, 66 aa, Homo sapiens
MELPLRLALLFGAVSALHLRSETSTFENPFGVLSTPALSDEETPEQRWRDLRYAEEREIHNSVITL

SEQ ID NO: 1023702 - protein, 107 aa, Homo sapiens
MRLSGHSPASASQDAGITGVSHCTGLFSPTLSFLPSLNSSVYPLPTSCYCLGVHLPLKGLFLQTVHFQTFRSPQVSRTAEDPTLVFKISIRIVFHATDAAVDSSFVD

SEQ ID NO: 1023703 - protein, 163 aa, Homo sapiens
KKLAGARAGGGFEDASSGLGRASERQHGIVELWSCECGERSVKGVPWPSKVGPRSCSSELVSNGVFESAQSRHDDPGVLGAMPGALRGAVAQWFRIRATESIHAWEPGYEWVARTHIVARVELLCLELAEYRLTFDHHIPFLVHHGLVRYYSAKLIGTLRNCA

SEQ ID NO: 1023704 - protein, 32 aa, Homo sapiens
MVLGPGDEGCWDLSGTAWGVVGLEVPGGMWEV

SEQ ID NO: 1023705 - protein, 37 aa, Homo sapiens
KLLTMYGDMLLHLYQPIESWQLLLDKADRIIILSFYK

SEQ ID NO: 1023706 - protein, 135 aa, Homo sapiens
AQEPVVGALRRTHHLEEVLRLWEPQGPAVRGSLGHVYRGSGYRIGRSTGRCQGRSRGSGALPGAQERRPGSRGQAAQAVGWGLSPGWEGVPRPGFPAAPGMGPRRAPSEGWCQTEPQLLCIPHNSPAGALGGECE

SEQ ID NO: 1023707 - protein, 124 aa, Homo sapiens
SRGSPSMASAAARAFCAFQCGRWRAAGSVTLWCRAVLSLLRACCGLAPVRPDPVPPIPQLRKESPALSGSHSVLEPLTPHVPDLCPWSQVRPTPWNSNCPSHCTPASHCTPGSHCTPGSQLHSG

SEQ ID NO: 1023708 - protein, 42 aa, Homo sapiens
GDLEDPPGRLDLFILLRLNVNLKSDDVLSLLKTIHLSVHLSR

SEQ ID NO: 1023709 - protein, 33 aa, Homo sapiens
GRLLLLLLLEFKLLTMYGDMFQTSLNKSNENPK

SEQ ID NO: 1023710 - protein, 47 aa, Homo sapiens
GCMHVDIEHENNNALRSMSGVDRSGYGHHSPGKLASWGSGFIMCSAQ

SEQ ID NO: 1023711 - protein, 155 aa, Homo sapiens
LLVFVECVLTRLRSFVCSSLSHSRMFILQPHRYIHSKVVKTFSEGEWLSFDVTDAVHEWLHHKDRNLGFKISLHCPCCTIVPSNNYIIPNKSEELEARFAGIDGTSTYTRGDQKTIKSTMKKNSGKTPHLLLMVMPSYILRLQQTNRWNKRALGC

SEQ ID NO: 1023712 - protein, 136 aa, Homo sapiens
GENPILCSVKEGATQLTHSAPTKEPKGETRRETGEEMRDPGSRPSGWDYKQALCDILPGPAPSSRSQTLSLAGTRCPTVMPLHGVPPQPAHCMILRLSSPTSPLGKWTLALRACPALCTCPPGVSFLPQHFSHGIT

SEQ ID NO: 1023713 - protein, 121 aa, Homo sapiens
MPLKRDSKMSAWSRKMQMWGTTEKVICGSLAGNNHLVQVIVQVIVQVIVQVIVQVIVQVIVQVIVQVMVQVMVQVIVQVIVQVIVQVIVQVIVQVIVQVIVQVIVQVIVQVIVRDPQSHRS

SEQ ID NO: 1023714 - protein, 234 aa, Homo sapiens
AEDAQRILTISLPEKRQSTLKAEATAPPAAFLSCYAEFPSMYQITACAKGLPGLPASVLEDVQNDMKHRLGFLLQKSDSCEHNSSHNKKDKAGYYCQRVSQRAKSRNGLNSLAKPRLRHAMCGWPAFQSLLLQGLTYQVQAAITRLLASAVQEYKTIKSPSKLSPKAKQRSIHELHLSPGNHKKVTPGFLHQGNVTSRHMLRAYNNLALMRPMKTIFNLMDKGSYRRFLKSRFY

SEQ ID NO: 1023715 - protein, 33 aa, Homo sapiens
GRLLLLLLLEFKLLTMYGDMEGVSLNANYFFKK

SEQ ID NO: 1023716 - protein, 46 aa, Homo sapiens
HLDLIMPAEDRQQYASHDFVNYYAEHPNSSFAAQVWTNNAWIAAQM

SEQ ID NO: 1023717 - protein, 85 aa, Homo sapiens
VAQCMVPGTAGHVLLTCRSKPELKQQLTGHSKRVAGSVTELIQAAEAMTGNRYGVDPEDPTSQLLENESPGRAAVRRLRAACRKS

SEQ ID NO: 1023718 - protein, 405 aa, Homo sapiens
GNPCHRAPGQRLHPGREGPPAPPPVKPPPSPVNIRTGPSGQSLAPPPPPYRQPPGVPNGPSSPTNESAPELPQRHNSLHRKTPGPVRGLAPPPPTSASPSLLSNRPPPPARDPPSRGAAPPAPPAVIRNGARDAPPTGSSNERRAETATHHAAARSATQDPPHPAPRQPPQTKAPGRRDPWTPQWTTQTTRPPDTAHKTAPHRQADNDNTTDHDPPPNRATDDRHQPQPHGHPPPRHAAETTHKKPQHDQTTQKQPRAAHQRTNDKQTTAEWNTNKERDSTDQKHTDETNQDTNQAPPRQTPRPPTHQPNSNHNDATHKQQPEDQKNTDNNQKHRHNTESHQPKAQNTNDTPKQPPPTQRTHGSHFTYGRHATPNADTNTHKQTERHDHKTTKTTATQKTHTPQA

SEQ ID NO: 1023719 - protein, 160 aa, Homo sapiens
RGRPSQCRVRRLLHRYRGVTLMQWPLWLPCSSSLLLLGLDSQFVGVEGFITGLLDLLPDSYYFRFQREISVVLCCALCFVIDLSMVTDGGMYVFQLFDYYSCQRHPPCSGRPFEECVVVAWVYGADRFMDDIACMIGYRPCPWMKWCWSFFTPLVCMGIF

SEQ ID NO: 1023720 - protein, 115 aa, Homo sapiens
ILFELLSWGVLAGPSADGPALPTVMSHPLSTSSHALPSNPCAAPPLKMSFQFSGASGPLGIELDPCCCPCIADTLFPPCLHGACTFTITATIVPVLPWVWRWHVQSQCVLLLTMS

SEQ ID NO: 1023721 - protein, 241 aa, Homo sapiens
RGNGGLRLRPGPRPIPLAPRCGSPGGPRCAAPSIPARRPAPMGGGPSAGAGLPSARGCDGDRSSYAPEGPGRITENIGLKAHRRRYRRRDEFQCLQKKQYLEPGREPKGTLFLETRTTPAAGAPDLQRGPGQGQKDIRRGVAEQGERRGGRLTFEDEIPPGKFRRRLTPRLGTGPFRRPPWQGPPGGPATALAPAFARFRWGSFRAVVYPRATPGEPRRGMVGPLWGCLGGPVARGALPHR

SEQ ID NO: 1023722 - protein, 285 aa, Homo sapiens
GGHATGGFLWRGNRYSRNTRASASVTTGGPDPTLPDLRAWVPCDAEAPRSRALRFWASQTPQMSKTQADPGVRRPPEIQASGIMAPPETLDSHCQIHPSIMVGTLYSLLERKVPRKRAHSRVKLSVFPALPRAKESRALRTPSFRTLWHTGQSREASDAQPGEFKHSSVPRAKELQCCELTTLRSPPKFQSPGAVTQLSPRNVGSWEGAQSAPSQLPGAKKPGAFPSLVADPPRDSNGARSGGGHRNGGLGAGSIEDQGAAAGGTGVPGQVRRASSQLAVLLNSG

SEQ ID NO: 1023723 - protein, 127 aa, Homo sapiens
MAASMITSPIVAPTSVPSLSRRGSSFAVVCSGGKKIKVDKPLGLGGGLTVDIDANGRKVGKKGVYQFVDKYGANVDGYSPIYTPEEWSESGDRYAGGTTGLLIWAVTLAGLLGGGVLLVYNTSALAG

SEQ ID NO: 1023724 - protein, 127 aa, Homo sapiens; identical to SEQ ID NO: 1023723

SEQ ID NO: 1023725 - protein, 74 aa, Homo sapiens
AEEDSLNVADLYSLRAQLDIPIPDPPPKDDEMGTDKQEKKEVPKCGFLPGARRSDVNGGVTDEINGLETWLRLL

SEQ ID NO: 1023726 - protein, 106 aa, Homo sapiens
STHRSIPASLTQSRTSNNTPSPGAYMITDNWYLLRSLMYPITKHRLINRSIYTLCCAALIERSLYIAPGSVVGPAPYPLVRSLRDRTNRIRNLQAKRLKPVVLSPN

SEQ ID NO: 1023727 - protein, 170 aa, Homo sapiens
MLLCKKLFVGGIKRTILRNITLEITLRNYGKIDTIEIITDRQSGNETEALALLLLMTMILWTKIVLQKYHTINGHNCTKLHEQRFVYTTRTMQEVHEFYQKWNDARPDLDYCAHHGWWRYPKRALMTNYGRTQNFMRNLATYHCILAYNSYTSQTLLNLTAPNRTDVKHP

SEQ ID NO: 1023728 - protein, 71 aa, Homo sapiens
LEIHGVIPPDDQDLFALLWGRLEQLKSKKDARIWRSRGKRDAGIREAKAKQEKVSAQYLSEIEMGKATGED

SEQ ID NO: 1023729 - protein, 36 aa, Homo sapiens
GARVKTGTQPEIAGVITQGTKTPDIHGRFLLTSVLS

SEQ ID NO: 1023730 - protein, 157 aa, Homo sapiens
MASKLLRAVILVAARLGQGAPCARGSPRNFGLHASLQLATSCWENIKASTDSSVSMATAVILEQQVFYGFHDHVITRLMHVPSSENRLGQAQAPLYGISPSVYPSEDRGRTTPMEPQRFLTAAVVIPSLEYQRFDIIAQNNEQELVKASASTEHGHP

SEQ ID NO: 1023731 - protein, 334 aa, Homo sapiens
VTPVFYGVFISQWHRGTTEGSAVVCLHNEGCARGVFSGLYKEVNRETQQWYNRDPPGAHTPGLERASSTVPGNRKINSSLQIPERVLNFLKEQFLMDGQSPEPAVLLLQPHGSATSDVGMYNRLYPVPGPNPYECPSSWALVTADLMKASELWAPGVHHQLRSLQIFSIGTARAESDPVTPTGGLLYADSHSGVVQVPMANCSLYRSCGDCLLARDPTVLGAVQLQARQLYQPQLAPGRGSGHRGSQRQGTCSASSVVSRFLYNREKHVSTSVQPTSEPFGCRSLQLGPIWYAGPRHARSAVSLAGGAPLGFLRAYGRRCLPGRGPRGPSLRRG

SEQ ID NO: 1023732 - protein, 34 aa, Homo sapiens
IELGTESRQCATLNNTALVIFIKVSPSVTRPLKS

SEQ ID NO: 1023733 - protein, 33 aa, Homo sapiens
GRLLLLLLLEFKLLTMYGDMEKWLMENKHQFPK

SEQ ID NO: 1023734 - protein, 37 aa, Homo sapiens
MALITPETTSSPARCVDLGLTLLADVQLSGSRRATAL

SEQ ID NO: 1023735 - protein, 73 aa, Homo sapiens
SGDEPVERRYTAPSYIILYTFYVQKEKLTIINSEVYSYITHYTGGVSLIRNAWDQRCFGFFLHFGIFALYLLV

SEQ ID NO: 1023736 - protein, 73 aa, Homo sapiens; identical to SEQ ID NO: 1023735

SEQ ID NO: 1023737 - protein, 63 aa, Homo sapiens
MALICGLIVVWFHLSPLHAKEEDFLASHVSPEVSDTAWASAIAEAIFLNIKACGNHFGEIMKV

SEQ ID NO: 1023738 - protein, 140 aa, Homo sapiens
MGDPSKQDILTIFKRLRSVPTNKVCFDCGAKNPSWASITYGVFLCIDCSGSHRSLGVHLSFSSPQLPFNQRQSFATFPNWAQWFQLRCMQVGGNASASSFFHQHGCSTNDTNAKYNSRAAQLYREKIKSLDLSSNTEAWH

SEQ ID NO: 1023739 - protein, 47 aa, Homo sapiens
TIHQFISLSSQAAPATSEMAASALHQTTSFLGTAPRRDDLVRSVGDF

SEQ ID NO: 1023740 - protein, 163 aa, Homo sapiens
RVQGGTEKPGRGLGPGPETDGNSGSVTHAAPTPPEQAPPCAQTPADSFDSGDAPAGPMQAAFGHRAPTTGESDTEQHSEAWDPEEGGGPGGLGSVGRGGRREEEEEEEEAPCDADWDEEERWWRVTGHKPTRIDLLIPGPYDSTHVPSRAASDHGTLEGPGST

SEQ ID NO: 1023741 - protein, 44 aa, Homo sapiens
VRLLLASQSAGCLTPEFVHAHRALGSCVRALLGCVVAPLESHCC

SEQ ID NO: 1023742 - protein, 103 aa, Homo sapiens
MSELEKATGGPHRRSPYLEEETAKLKNRIRAHHMSFPCLRNQEQRCGQVMKPDMMERECDSGIMAVAWFYCCTSLELSEKAQTPVQNGMQKQTAKGLQALARS

SEQ ID NO: 1023743 - protein, 132 aa, Homo sapiens
MSELEKATGGPHRRSPPTILARDWETHAQAEEIRHCMEHRSTMSVSHFLEDNSKSQEAVWTKVIGMHRGQGWRRQNVTFQEFNVPLLPLVYYLAAYRVLSEHDVRLAKQSNLILVNRRQVMRESRQLRACKP

SEQ ID NO: 1023744 - protein, 188 aa, Homo sapiens
MPSPGSRLTKKSVLVSVSEVKAVAEMQFGELLGCCEEGPGHSVMLFLEEKEQAALSQANGIKAHLEYRSAEMEKSTQELEEDGGHQRALSSSLEEYCKFKNTEDTHPSLSVYSRARRINVSGIRNVITEIQRYTLIQLLENYKKKLQEFAKEEEYDIRTQVSGVVHAQNMDFHELSPSTREQFLQVCV

SEQ ID NO: 1023745 - protein, 56 aa, Homo sapiens
AEVYTIGLGRGTWSLSPQREDLGLVGDAEETTDQVPGPSAWAPKIFRTVIYGRCLA

SEQ ID NO: 1023746 - protein, 225 aa, Homo sapiens
MKATWCAPLVLDPARLWPWGCSMLLRSVALEMALESYEPVMSVGPQICLVALNLTRLSIGLVNQVPKGTAGAFMFPYFIMLIFCGIPLFFMELSFGQVCKPGVPGGLEDQSPCSKELGYGMMVVSTYIGIYYNVVICIAFYYFFSSMTHVLPWAYCNNPWNTHDCAGVLDASNLTNGSRSAVLPSNLSQLLNHSLQRTSPSEEYWRLYVLKLSDDIGNFGEVRLP

SEQ ID NO: 1023747 - protein, 261 aa, Homo sapiens
MDAVVPGLKLVAGVAAVMLLLWVHLITTFTCASLCVLDVCLRVLVLLLDACRVAQCGQLLHCALPCRSGCHESLLLLGPDDGVLPLPCRMPVSFPAEPRVGCPMTVLAVLTVLPVLNGVCVLEKRSGGLLAAVEAGMLLLSSAELRGLQLFEGQGGTGAGQAQRRLRLRPGIKCRVSALEEHLGCHIYFTLVTEGGPGDRTSRLPPGKDPGLETAKITLEPGQVQRTMKAIQTVRARTEPRDRDLVVLEHRAHIYPSLYQQ

SEQ ID NO: 1023748 - protein, 156 aa, Homo sapiens
DINVTDQAIAGLNGMQLGDKKLLVQRASVEPRMLTVSPEHINETPVYPASAGLDELPGADGRHPTEVLCLMNMVLPEELLDDEEYEEIVEDVRDECGSPGLSRPSEIPRTCVTAVDVPGCGKILVDVHLLCNDVQKAMQGLIGPKVRKRVVVTEVL

SEQ ID NO: 1023749 - protein, 319 aa, Homo sapiens
SGGMTREARWSQGQKWRLLTPGNSPEGGAPPNPPGSKDTSRPAIKPRTKHTPESGTRLYAQGQIPKRDTRYRGERGQRPKNTSVQAKHKRTHGDGAPDLEETLRSVPTHHALWRHHNTGDGRDNTQQQEPNNEITRRQDTEQPTNTQNEKTSSDAYICEPRTRPNPHRTTQRTPTTDTTHHGQNRDDTHHRTQAKKTEPTRTNQDHQTARGTNTEDEENQHKEQDKEEKRMKPKQEERRRRKRPQKKARRKQHTKKNSDTGRQKDKLHKKPVKANHNRQKAPRTKRREQRQQKKKTEHQKKTKKKKERKRKTQDTNATK

SEQ ID NO: 1023750 - protein, 47 aa, Homo sapiens
EEKAAVTEAVRALLANQDSGEVQQDPKYQGLRARGREIRKELVHLYP

SEQ ID NO: 1023751 - protein, 124 aa, Homo sapiens
LLSSLTLPGALGSPSFSDKMSYQKKQPTPQPPVDCVKTSGGGGGGGGGGGGGCWLLRRRRLMAAGSSWFLAAGYSWLAGGILWRRLLCGGSSGWRWRLVAQPIGSASGNAVAHLMREACQTIRP

SEQ ID NO: 1023752 - protein, 35 aa, Homo sapiens
HGFAGAVQLGLIGTRIRARIRASNSSLEFEIQASN

SEQ ID NO: 1023753 - protein, 134 aa, Homo sapiens
WTRMSEEQMPLELSMSSVSEGLPRDTKMPRLILAGSRAQLEMPTKRILMCFGTAGSSSLHPSSSSGGRVFRGILGESSASPTSSNTTTETYCCRSFLLLKAGALPEGADDALWGGVRAALEGHQVDLLQAAEEI

SEQ ID NO: 1023754 - protein, 180 aa, Homo sapiens
MRRHCSWPRLPPASHSTDQHPNPTTNRACRPGTARKLTMRSDAMHSRPDLTPSAPGGDLAHLLPATRPSPHTRPPPPSLRTTPHQPRPPYPAHPAGPATAPGRHTNHPASAPQPASGHPWPCPPPATPSGPVRRPPPPGAPACQARPPPRNPPPAPRRPNPAPRSTPPRRPPARTPIWGG

SEQ ID NO: 1023755 - protein, 141 aa, Homo sapiens
AEGPCAACDFAPKYLLPRCPGQQSQQQCQPPPKCTPKCPPKCPPPNALQSVPLMCPPDLFLLRVSAPEDCVMAPALGGELCASQLWGLLQLWGRWLLPEPPQAPQVPPSQNPETLTAADQPSEGLQTAVEGAADSTLEAAC

SEQ ID NO: 1023756 - protein, 124 aa, Homo sapiens
PLTESKNFPKLTQNYAPELANSLLASDASMKYSPFFLHTETLDFSENTKPLPPSHKVAVYSTLLPCTSGLRSGVLSSLILITIPRLLGHHFPHALALITTFLLCLEFGPQVWFLLITSKFKSKS

SEQ ID NO: 1023757 - protein, 166 aa, Homo sapiens
REYKAHQLLIDALVDGQVVALLVQNLGAAWHESVKGGGKMASTTLWLKWKTWLSAGLRCVQRVPSRVFYSGLLEEAEGNMMPLVMPTNCIAVKLLAILLQDNDETSGNGLGRLDGIDVASSCSQLIRCITRDEQFPANGWRSEEMMDGIWSRCPSCVRALMLCSNS

SEQ ID NO: 1023758 - protein, 146 aa, Homo sapiens
SRIGEDTQVGVSRTVVYTAEPLQLCFAGPHPRCWVQDVTRWHGKLPGERWNWVFEGGPHGGSSSPSTATVGPCQEQVLRSLCGSQDKRSTRSSLEAAADDTVGPAQPRPQQLTPLRSEDVAEDVAFPSSSQENLVLLLRGPHFEDH

SEQ ID NO: 1023759 - protein, 96 aa, Homo sapiens
EGDPIKEGSSSEKIGGLALRKNRRSVGKLQPLAIRFYVGLSRAHIRAFPSPSVHTHVSHVSRRIAQRALLSLSLLIWGSGIVSSRFSIKGIIFSRP

SEQ ID NO: 1023760 - protein, 64 aa, Homo sapiens
CVCISTSYPERANNPSGAPAWFKCMVQVHGSSAWFKCMVPSAWFQVHGSKCMVPRVGHGSSQSV

SEQ ID NO: 1023761 - protein, 93 aa, Homo sapiens
IAHSQPANVISESAGEGCCHHRGRKAAISRSVSSAAIGRSFNFGRGERQCTFLLDIDRHQADAAFLHQHPRPFRRQTGFQQGVGGAQRWVAGE

SEQ ID NO: 1023762 - protein, 77 aa, Homo sapiens
ALRGYPYAYPPMPAMVATPWLRGLVPRFRYPARMAWSAVRIGLIWDNWVTVGVKSKSELPSDGPSPQPGYRTRVSKK

SEQ ID NO: 1023763 - protein, 123 aa, Homo sapiens
ALRGYPYAYPPMPAMVPHHGFEDWSPDSATPPPIGMGGIASPQIAPLPSAGIHWRLPCEGSIQSDPVMTHSLQNQSLQKMTVRGLSETRLCHLAPPSSCRASVISDCQENRSHLHGVARDSAG

SEQ ID NO: 1023764 - protein, 285 aa, Homo sapiens
ERDWVRNSQGCERPGRGDRTLQDETLGVASCPRSGGPSRASAGETELGATAVAFSSFDPRLFILGTEGGFPLKSFPWQHGEAALTRMPSCRGPCGPQHSLPSPPTAVPLYSVSCSPFHRNLFLSAGTDGPCPPCTTMLQAPPLTYAADSPLKYLFAVRWSTSAALGFCSCLMGKVTCSCLISRKAPRKPTVLIKQTQDESPVYCLEFNSQQTQLLAAGDAQGTVKVWQLSTEFTEQGPREAEDLGLPGSRGGGLRGPWQAGEAFAVPSLVLLTQCTARKAKVFTK

SEQ ID NO: 1023765 - protein, 427 aa, Homo sapiens
GSSCWVLLFVVSLCYSSSVVSCPPHRSSFRVLHRACAFSTLCFMSLGALRVYFLTCAVAWESLHGCPPLWGGLWFLWSSWRAPCSCVDKPGGKAWSCNPWHMSPLVIYPGPTMRVKLTWLCGCLEPWGTSHLFFLGGLDELTTGRKAATLAGNRASQECSVTEGFALVIQQLPTEHQAQEASPPGRPELGATAVAFSSFDPRLFILGTEGGFPLKSFPWQHGEAALTRMPSCRGPCGPQHSLPSPPTAVPLYSVSCSPFHRNLFLSAGTDGPCPPCTTMLQAPPLTYAADSPLKYLFAVRWSTSAALGFCSCLMGKVTCSCLISRKAPRKPTVLIKQTQDESPVYCLEFNSQQTQLLAAGDAQGTVKVWQLSTEFTEQGPREAEDLGLPGSRGGGLRGPWQAGEAFAVPSLVLLTQCTARKAKVFTK

SEQ ID NO: 1023766 - protein, 37 aa, Homo sapiens
WYRVGAMVSYLVLGAGDIGGGVEIAAILFLDDDAHRI

SEQ ID NO: 1023767 - protein, 284 aa, Homo sapiens
YTTTAPLSESTDAGHARVFLRAMATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEASLELKVKEIKNGRLAMFSMFGFFVQAIVTGKGPLENLADTLRPVNNNAWAFAPLRA

SEQ ID NO: 1023768 - protein, 79 aa, Homo sapiens
ETYLWQLSPVGITMTEDMIGAMMIGTTIADHTEEEVEEEEDGELPKTGIRFIEGGHLLLTIVVEDTDHVPDLESYSPRR

SEQ ID NO: 1023769 - protein, 111 aa, Homo sapiens
MGRTCPWRKRPKNVPPPGSSPNSLYSSTERPPCVGKTRGGTHVYGLNWGPPKIAGTGGNYNLPLGARIPCLISCTPQIFDEREPHNTASFDPLSRRFEIPRKIRAVRCTHY

SEQ ID NO: 1023770 - protein, 103 aa, Homo sapiens
RPPTTTKFAAASTFHADSLFSLVMFHADSLLSLVLFHADCLFSLVLFHADSLFSLVLFHADSLFSLVLFHADSLCLAWFCSMLILCLARFCSMLTVCLAWFCC

SEQ ID NO: 1023771 - protein, 147 aa, Homo sapiens
MVLARSAGGHTGTAKCMGDPTEAAGVGAGEKETLADGFCPRAQVSRGSEVPDKPGLKNPGKTGMRAPPGLVREPRLLPGNPAMRSREPLPGTWTGLGSRDAQESFLVILDSLLCVESLAGPGNQGILGRSAEGRHAFHTSLRSPEES

SEQ ID NO: 1023772 - protein, 90 aa, Homo sapiens
PARQIPPTSALGDSALRPGDDNSLGSLLPAGLYLSGPGTHPLHTWDSKVRNILQARTPGTIQVVGTPASTKGASKVPSASPLPSEALPLP

SEQ ID NO: 1023773 - protein, 169 aa, Homo sapiens
RDGTVTGLLTKVQLRSNQRVGRGQSWGGLSGGLWDNRLALYGTFGTRKLEEAYACFKMRMQLWDDSFADESLMLEEQREWVMSQRRFRFENETLVDDTECKYGKGRLCVCHKGGVSLMGVKVTEVVVSVDGNSYSCVPSLLFTMSYWLGSRDVVSPAMFFVHKDVFCSS

SEQ ID NO: 1023774 - protein, 134 aa, Homo sapiens
MSASLLAAAGDQDGHHHQGEPRSAEMNTGGLLDPSPAALGPTPLPATSPALVFYEDDYRYYYDDDSCLQEDQEGDHDAYQLLEDEDEDVAATGSLADRLRDLVRQRLAEVNASSAVVAGLGLVGSAVGAYFLWP

SEQ ID NO: 1023775 - protein, 207 aa, Homo sapiens
MASIYGTLFCLPRSVSNSIATDTETSTEMVADRWSRAYRGLQDLEPRESRAWDGSDGEVPAVSSLVGVPRPSCKSQPAPCFQSFRGRFDDGAEAAFRSLSTPELLIHKSQLWGRDGARLLVGEKRLNHSKDRKSAEITLGTCTESEKEEDSQQGAPGKTGPNYPKGGTDSWGMKPVGFRRTHGRIYLRSRGLRRPGKRRRPGRGYQA

SEQ ID NO: 1023776 - protein, 44 aa, Homo sapiens
PSVAAAAAHQQLALFHPAAMAATTTMALSSPAIKLAGASYALGG

SEQ ID NO: 1023777 - protein, 229 aa, Homo sapiens
MSPKRIAKRRSPPADAIPKSKKGLKVSHRSHSSRTRHGADTRPGDVGQLGLGENVMERKKPALVSISGGRGAGLEAGGMHTGVYSKSGQVYSFGCDDEGAPGREHIQGGLGDGPWESGAAREGGTRCQRETSPSRPHAMMAVSVSGGSSGDITGRLDWWRRKKHGRGGTDVPGKGATNHLARRTEDPNPARGRPTRGENPGAQPQRPTGTRTPQNTAAPPAGAPNAPPK

SEQ ID NO: 1023778 - protein, 33 aa, Homo sapiens
DIPESFNAILLFDYLDPYCIVPENPTCEARDSR

SEQ ID NO: 1023779 - protein, 63 aa, Homo sapiens
FHPAPPVHTAAARVSSRPRGEERRKRYSTTGNHGGGDRQQRREAEPVGGALRAGELVPPRPRA

SEQ ID NO: 1023780 - protein, 231 aa, Homo sapiens
AEHSSELEPAPAAWSSKGVRDQGQRAGERSPRPRALVTCRTLRCGCVCHVAPEAMTAGGLSGWQTAGVLPWPPEHRDTLNTRSQPCVLLKLYSDEQMGGGQQRTEVLRILFPGPVFSRGDWGHCSYLFGEEKQTLVLVPACSDAEDGCRAEPPEMISFLRALLECTFGPRWCHKPWFTKPLLLKNGKTAGKSTITIVAEEVSGSNDYVQLTFRAYKLDNKDLSSKSDPFME

SEQ ID NO: 1023781 - protein, 50 aa, Homo sapiens
SYSRGSCECNGIHRRDPLLISTGVLTCSVSELCWFNPSFMATGCPPGSGE

SEQ ID NO: 1023782 - protein, 214 aa, Homo sapiens
EPERASSQDARNERWLATHPRPGHVLRSCSGPVTRAPDPGPIPASWRRGPPLAGLAEQLRVRPPQTAASIPQPRTRYHRLVRMDVSMTGPVHGQGRASRQPAEKTQAGWSTRGGGEDQGGRPLRRKQRPDEECGTKVWLSSWLKKPTGTGLTFWEAAVILMGAGNIDSSTQGLVKREEFPTDLKPRGRGPGSCCRTLIEHHDGATKGESNEDHP

SEQ ID NO: 1023783 - protein, 214 aa, Homo sapiens
MEGEAQSEGTPARGARAPDPAAAAAARSPRRALWGPGPGGTLPREKAVETWAPTPVHPPQKPRSPVHSRGSTSGKPYHCAPRGQHLAPGQESRGMAVTSASMDVVPGVMGVKRSSGAWSFLGHIPGGPVIECRNSKMSLEGVALRALLESTLSTSPKAKMRLSKEEDRTIVRHARWRRVGTEAFEKRGERSKLSGLPAPAQRDKFRQRDMGRPR

SEQ ID NO: 1023784 - protein, 31 aa, Homo sapiens
MIRHIVCVEALWLLAEGSACLCQPIKVQFPR

SEQ ID NO: 1023785 - protein, 175 aa, Homo sapiens
MAPTVMASSATSVSSFPGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 1023786 - protein, 276 aa, Homo sapiens
AGARPRRPRRSPHPPGAVSPGCGSSSALRSSLPSRIAGASRGGDRSRRPRAGGVRRRAPGCGSSCRWQGGASPRGVAQPRERWGGGRGRRPQGEIAGSMAGLRARGARRPGLLALSALGFCLMLQVSAKRPPKTPPCPPSCSCTRDTAFCVDSKAVPRNLPSEVISLTALADPTVLTRVSPQTLVNAAFSEIQDGAFSHLPLLQFLLLNSNKFTLIGDNAFTGLSHLQYLFIENNDIWALSKFTFRGLKSLTHLSLANNNLQTLPRDIFRTLDIPE

SEQ ID NO: 1023787 - protein, 261 aa, Homo sapiens
AGARPRRPRRSPHPPGAVSPGCGSSSALRSSLPSRIAGASRGGDRSRRPRAGGVRRRAPGCGSSCRWQGGASPRGVAQPRERWGGGRGRRPQGEIAGSMAGLRARGARRPGLLALSALGFCLMLQVSAKRPPKTPPCPPSCSCTRDTAFCVDSKAVPRNLPSEVISLTLVNAAFSEIQDGAFSHLPLLQFLLLNSNKFTLIGDNAFTGLSHLQYLFIENNDIWALSKFTFRGLKSLTHLSLANNNLQTLPRDIFRTLDIPE

SEQ ID NO: 1023788 - protein, 312 aa, Homo sapiens
QEPIEDDTAVVHQEAMRNTYCHSSRVLCLVIAPTMMGHTIPDSVPTPLEMPIKMLAERGAMSKWFTLNPEMAKPLEPTARTRKEDGPRPWSASYPTTSSSVASIPKPPQFMSFRTLVVDIYVTLRKKVSDLASNGYDDGHDKVRQRRHQPHLADLKAEHFFKVGGLRDEEQVEGPAAAKVRNDDGIDGHGRKEAPPGVFNFVTGFMSLGLSRMASSMYLRSSSEMLGCSAGESYGDKRTRKGTKRSRSCHRHRRQNSILNTAQGPQPRAWQPPPQHRNRKRLSLPADSVLREGPICSRCHGQAGYVTPSTNP

SEQ ID NO: 1023789 - protein, 95 aa, Homo sapiens
MASQGVASMFALALLLGAFASIPQSVESIGVCYGMSANNLPAASTVVSMFKSNGINSMRLYAPDQAALQAVGGTGVNVVVGAPNDVLSNLAASPA

SEQ ID NO: 1023790 - protein, 288 aa, Homo sapiens
QLPLKADPYKQADHQGWSQATRLGAMQKWRSAPGKAGECRKEGGLREAGGSLPSPLWSWAGAVAAPKQPDVSFTTAAERQFPPSVCPSSVVVLRSSLRERAEEVALLASHDSPKGRFHKPHWQMGLPGQRLNHDTPPIVPRGPRHRNGIYTLRLGVDGKLIAIGEKIKTQEHHPWEEIGEQTWHHKMEFHTGEELANRTGRHNHRLEATTYGNGGNFPSVKRKETRERKRERHTFDSDYTHGSGCRTSWAATRGGRPEAKVSDVGSTKKRMHRPRHQPARDMEKGRNP

SEQ ID NO: 1023791 - protein, 195 aa, Homo sapiens
MEICPGEGRFLPKRSHVRTSLGMCLQEKCGLPSSPWMPVGCLPHPGCLWAAFLTLDACGQPSSPWMPVGWLSSPLECLWAAFLTLDACGQPSSPWMPVGCLPHPGCLWAAFLTLDACGLPSSPWMPVGSLPHPGCLWAAFLTLDACDLVSMAGFLSSGTPRPPSNLMTRPVSEHTCVVPEPLTSPLWNPATHFPS

SEQ ID NO: 1023792 - protein, 105 aa, Homo sapiens
MKESLDDVMDSLVTKKWLVGPCFILELTESQNAQDQGDREWTSSSQETQSIWSIKLIKPAPITSACCGQTDDTFCYVEINLLGNPEIGKQVASIKALNCSCFQLN

SEQ ID NO: 1023793 - protein, 33 aa, Homo sapiens
SGRLLLLLLEFKLLTMYGDMEIKHPILPWAPAK

SEQ ID NO: 1023794 - protein, 38 aa, Homo sapiens
YAGTKYLVYILQKRNAAVFHSVVPNFCLPTESFRPQIF

SEQ ID NO: 1023795 - protein, 41 aa, Homo sapiens
AAAYYYYYCSIQASNDVRGHAMVAFPFSMNEFAFNKQPDPK

SEQ ID NO: 1023796 - protein, 51 aa, Homo sapiens
SRLGLDLPWPQRYWDWISSLVRGDLGTSMVSAEPIGPQIASRLAVTGWLVG

SEQ ID NO: 1023797 - protein, 282 aa, Homo sapiens
PGVLCRLLTTIGKELDFEKAKPRMDQYFNQMEKIVKERKTSSRIRFMLQDVIDLRLCNWVSRRADQGPKTIEQIHKEAKIEEQEEQRKVQQLHDQGARGDQASKEWMKVDGILYKGPRTVVYWIPSKFLKITKPTIDEKIQLVPKAQLGSWGKGSSGGAKASESDALRSSASSLNRFSPLQPPAPSGSPSDTPLEFESRRALTSRGSMGRERRAKSNSNWNSRPPLVPEGAAERPVEHQSHEEQREKVVGPGTVKGADGEGHIGPAEKGASNWSVGGSLNLL

SEQ ID NO: 1023798 - protein, 104 aa, Homo sapiens
MAFPTRSSPDPSDFDRCCKLKDPSASIVVDPPEGEVESGELRWTPEEYLVQEDEQEELRRDSDRKIKSSRKSPVDSHGSYQTASVPELCFIPIMTEEESEPQLF

SEQ ID NO: 1023799 - protein, 191 aa, Homo sapiens
MPTLVVGTPPTCLGDTPQPCHKNSQRQGPFSHGAPGRAADWKAVAKPRLCAPAAEDDVAALRWPGPSQQPDPPWAAPHVVGSDDLKEPGPWGKACSLPMWSTGPEARDGDSSVSSGRLSCSSGGHDVCVSWKERPPQVVGPQQRPRKSDARLEQLRDKIRAQAWQQGELCVPGHLSPSKASRVHKGFTLTL

SEQ ID NO: 1023800 - protein, 172 aa, Homo sapiens
PASRPQRQPHVWASHGSWPLGPTVAGKGRLCAPAAEDDVAALRWPGPSQQPDPPWAAPHVVGSDDLKEPGPWGKACSLPMWSTGPEARDGDSSVSSGRLSCSSGGHDVCVSWKERPPQVVGPQQRPRKSDARLEQLRDKIRAQAWQQGELCVPGHLSPSKASRVHKGFTLTL

SEQ ID NO: 1023801 - protein, 32 aa, Homo sapiens
GRLLLLLLLEFKLLTMYGDMTKNQKCIQPYQK

SEQ ID NO: 1023802 - protein, 43 aa, Homo sapiens
MSQWLVGARYVCVQDSRYWVMDARSSGARRDSEMQAARMAASL

SEQ ID NO: 1023803 - protein, 69 aa, Homo sapiens
AGTKRLFHPRVGSTSFPAFSLQAPILLVSAGRKPFPLGTSLPSVTGGVRPERDSGVMSGSGLAAGQDLN

SEQ ID NO: 1023804 - protein, 68 aa, Homo sapiens
RKYLGHVVQMNYHGENSLRLAVDILSTGFQTFSPGNICMNSTRYPTLAHCDILHPPPILPDLTQPTDP

SEQ ID NO: 1023805 - protein, 179 aa, Homo sapiens
MAPLRPFFILALVAWVSLADQESCKGRCTQGFMASKKCQCDELCTYYQSCCADYMEQCKPQVTRGDVFTMPEDDYWSYDYVEEPKNNTNTGVQPENTSPPGDLNPRTDGTLKPTAFLDPEEQPSTPAPKVEQQEEILRAETLIKDPEFQKENCAVEAFDAFTDLRNGSSFGFRGRTGFS

SEQ ID NO: 1023806 - protein, 81 aa, Homo sapiens
GDSRAAVYEERHWDEERHWDEERHWDEERHWDEERHWDEERHWDEERHWDEERHFIVMLWKPSYILNFSRSKPPKSSIIAD

SEQ ID NO: 1023807 - protein, 69 aa, Homo sapiens
VTLEPLFMRNVTGMRNVTGMRNVTGMRNVTGMRNVTGMRNVTGMRNVTGMRNVTITELLTPNWTNLSPY

SEQ ID NO: 1023808 - protein, 62 aa, Homo sapiens
GDSRAAVYEERHWDEERHWDEERHWDEERHWDEERHWDEERHWDEERHWDEERHWQAASNTC

SEQ ID NO: 1023809 - protein, 68 aa, Homo sapiens
VTLEPLFMRNVTGMRNVTGMRNVTGMRNVTGMRNVTGMRNVTGMRNVTGMRNVTKLLISQPGFMVLSV

SEQ ID NO: 1023810 - protein, 94 aa, Homo sapiens
VTLEPLFMRNVTGMRNVTGMRNVTGMRNVTGMRNVTGMRNVTGMRNVTGMRNVTGMRGEARRLEKEEKYTEGVFDCVVRVEGDFIGMGVTFLIP

SEQ ID NO: 1023811 - protein, 304 aa, Homo sapiens
AGLRGTWLSLQSLVSPPASLLQQPELESDPERTLAMDSALSDPHNVQCLMAVLCPPTALLLAAFHALRCIALAYGSLLLMALLPIFFVRPCSSCTLRPLARMLQTLPEDKSPAGIAARFPIIASLQHVIGGSTSFIQNILPSELHSNFLLVHGIPPDAGEIPGPWFKRHTISPFMTLRVCQASVSKIDRYQSALHNRALGKTKEEIINYELRHRRHLVCLGPEAASLDVLDNLLRKHWIAKNLYWTGLPPLMDVAAPAASQNVSHWAAFLLVRDLSSYECPPGYFGTNCDGDQRASTSRNNKTE

SEQ ID NO: 1023812 - protein, 129 aa, Homo sapiens
KSEHGAEEPGRPMALCALTSALRSLSLASAAITARVPTLLPAAQIQSNVLLQLPPALVSPSYRPVHMSADRSAKFVSWKSRTKYTVKPVKMRKSGGRDHTGRIRVHGIGGGHKQNYRMIDFLRFRPEKE

SEQ ID NO: 1023813 - protein, 38 aa, Homo sapiens
VYVDERGNPEGSLSAVSGTQVAVNLGQKVSRVLYGLLM

SEQ ID NO: 1023814 - protein, 447 aa, Homo sapiens
MDEEYDVIVLGTGLTECILSGIMSVNGKKVLHMDRNPYYGGESSSITPLEELYKRFQILEGPPESMGRGRDWNVDLIPKFLMANGQLVKMLLYTEVTRYLDFKVVEGSFVYKGGKIYKVPSTETEALASNLMGMFEKRRFRKFLVFVANFDENDPKTFEGVDPQNTSMRDVYRKFDLGQDVIDFTGHALALYRTDDYLDQPCLETINRIKLYSESLARYGKSPYLYPLYGLGELPQGFARLSAIYGGTYMLNKPVDDIIMENGKVVGVKSEGEVARCKQLICDPSYIPDRVQKAGQVIRIICILSHPIKNTNDANSCQIIIPQNQVNRKSDIYVCMISYAHNVAAQGKYIAIASTTVETAEPEKEVEPALELLEPIDQKFVAISDLYEPIDDGSESQVFCSCSYDATTHFETTCNDIKDIYKRMAGSAFDFENMKRKQNDVFGEADQ

SEQ ID NO: 1023815 - protein, 74 aa, Homo sapiens
ETGSSSCGIPSWRHKVRCRVIFSPSGDNSVTENLAASSACFVGSFHCTAIFKPADYFQQLHRLNILNFKAANDR

SEQ ID NO: 1023816 - protein, 244 aa, Homo sapiens
MEEAASQSLEEDFEGQATHTGPKGVINDWRKFKLESEDGDSIPPSKKEILRQMSSPQSRDDSKERMSRKMSIQEYELIHQDKEDESCLRKYRRQCMQDMHQKLSFGPRYGFVYELETGEQFLETIEKEQKVTTIVVNIYEDGVRGCDALNSSLACLAVEYPMVKFCKIKASNTGAGDRFSTDVLPTLLVYKGGELISNFISVAEQFAEEFFAVDVESFLNEYGLLPEREIHDLEQTNMEDEDIE

SEQ ID NO: 1023817 - protein, 281 aa, Homo sapiens
MAATTMSLSSPAFAGKAVKNLPSSSLFGEARVTMRKTAAKAKQVASRSPWYGSDRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEIVDPLYPGGSFDPLAFADDPEAFAELKVKEIKNGSLALFSMYGFFVQAIVTGKGPLENLADHVADPVNNKRMGHSAPTLSPASKVGARACGEYAVSV

SEQ ID NO: 1023818 - protein, 55 aa, Homo sapiens
FRVWCVMHYGDLSQLPQDELQPPERALHVPSNQAPASRPPTPPRPLPASGILAPL

SEQ ID NO: 1023819 - protein, 41 aa, Homo sapiens
TGDLEDPGTMGWLSQIRISGYMLIKNFKDLVPTVRLTVISA

SEQ ID NO: 1023820 - protein, 164 aa, Homo sapiens
MWPPTGELVQSGKSEISELRRTMQALEIELQSQLSMKASLEGNLAETENRYCVQLSQIQGADWQRAREQLAQASLRDGAAEPEKYKILLDVKTRLEQARLPATTGLLEGEDAHLTQVQERTGEHPSGAYHCGQRSTDGQVISSREQVHQTTLAEDSSYPWRASH

SEQ ID NO: 1023821 - protein, 307 aa, Homo sapiens
FGARRSSEEAGEAAYPVPLPAAGTMGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFDRASEYQLNDSAGYYLSDLERLVTPGYVPTEQDVLRSRVKTTGIIETQFSFKGPQLQNVRCGRAAFPRRKKWIHCFEGCERAFIFIAGLSAYENGCWGGRTQLNRMGKSWTCSTGWDHRNWPKVIWASSQEGGFPKKRGLIVRIWRF

SEQ ID NO: 1023822 - protein, 71 aa, Homo sapiens
QELRYIEALSAIVETGQKMLEAGESALDVVTEAVRLLEELSTVLTPELALSFTRDETHELDACVMDGNTLK

SEQ ID NO: 1023823 - protein, 80 aa, Homo sapiens
LYRSLFAVLFHHLQAPPGLEDRVATLLEARLKWLGIDGGFSDVPHRSWSLEPTPVPPREEYMVPALGGMQARGVGTMFFI

SEQ ID NO: 1023824 - protein, 161 aa, Homo sapiens
FPSSITIGTKLDSTGAPSRTVIPGGMKGYLGKYQDMGVTIYLTPDGKHAISGYMYNEKGENLSNTLIEKEIYAPAGREMWQRMEQSHWLLDGKKDAPVIVYVFADPFCPYCKQFWQQARPWVDSGKVQLRTLLVGVIKPESPATAAAILASKDPAKTLATI

SEQ ID NO: 1023825 - protein, 283 aa, Homo sapiens
MYLRRAVSKTLALPRRAPPGPAPLGKDASLRRMSSRKFPGTSGSNMIYYLVVGVTVSAGGYYTYKALTSKQVRRTEHVAEPKEQTKAELQPLPGEKEEHVAEAEQVCSEPGDTAVTEAESVDAEEVPEAAVVLPEESQASAPSEVPAEAAVVEASLSSSEPELKITEASLVETTESVPESTQEVESAAPDQDDVCNEGADTSQEGADTSQEGADTSQEGADTTKEEADNSKEAEGTTTEDPRSISEESAELEESPPLGSEPPAQPESQEEETQVTEETASPQG

SEQ ID NO: 1023826 - protein, 57 aa, Homo sapiens
DGQLKGQRGPRISRGLARAKTVALESLPLALPSTPSHQLQVPKNKCVLELNFCDLLV

SEQ ID NO: 1023827 - protein, 340 aa, Homo sapiens
AGSVPSYFLLPHGCCCRPGVSEGFRGFGAGCEMPGRGRCPDCGSTELVEDSHYSQSQLAWLRVLRLDKRSVVKHIGDLLQHRQSLVRSAFRDGTAEVEPDCGCVVTEGVLTTTFSDEGNLREVTYSRSTGENEQVSRSQQRGLRRVRDLCRVLQLPPTFEDTAVAYYQQAYRHSGIRAARLQKKEVSVGCCVLITCRQHNWPLTMGAICTLYVLHDFATVFSRHITLQDSEAPGTGCAISVLGRTGERPIAADFKLYQAFSFLCQPNTWKTKEKIGVSNKCRMVEAGTAENVARLTWDANPLARHYCQRNFLALRSRTQPDTLSRYIFAFPDFVTHAQCD

SEQ ID NO: 1023828 - protein, 299 aa, Homo sapiens
REVSPPTSCCLTVAVADQESLKASAALGPVVRCQAEAAARTAAPRSWWKTRTIRRASWDCGCVVTEGVLTTTFSDEGNLREVTYSRSTGENEQVSRSQQRGLRRVRDLCRVLQLPPTFEDTAVAYYQQAYRHSGIRAARLQKKEVSVGCCVLITCRQHNWPLTMGAICTLYVLHDFATVFSRHITLQDSEAPGTGCAISVLGRTGERPIAADFKLYQAFSFLCQPNTWKTKEKIGVSNKCRMVEAGTAENVARLTWDANPLARHYCQRNFLALRSRTQPDTLSRYIFAFPDFVTHAQCD

SEQ ID NO: 1023829 - protein, 136 aa, Homo sapiens; identical to SEQ ID NO: 778873

SEQ ID NO: 1023830 - protein, 85 aa, Homo sapiens
LQTVTVNSIDSAGIQLHPGENADSPADIRIKEEEPDPEEWQLSGDSTLNTNDLTHLRVQVVDEEGDQQHPGRKKTSEGSLHLSQL

SEQ ID NO: 1023831 - protein, 268 aa, Homo sapiens
MAACGKTNKSHVIFKKVSRDKSVTIYLGKRDYVDHVSQVEPVDGVVLVDPELVKGKKVYVTLTCAFRYGQEDIDVMGLTFRRDLYFSRVQVYPPVGAMSVLTQLQESLLKKLGDNTYPFLLTFPDYLPCSVMLQPAPQDVGKSCGVDFEVKAFGSDITDLRRTRSPKKKSGRFLIRKVSMPPEMGAHQCEAREASVWKPELFVPRKRNSREPPGWTGTTARGDTSRDNTGATGNNRPKQKKHRQGGKEGREDTQTRVRYHDRTKKESR

SEQ ID NO: 1023832 - protein, 112 aa, Homo sapiens
LCALGRRSREPLEWEKARQVLASISKSGAAGGSAKSSSNGPVASAQYVSQAEASALQQQQYYQWYQQYNYAYPYSYYYPMSMYQSYGSPSQYGMAGSYGSATPQKPSAVPRH

SEQ ID NO: 1023833 - protein, 42 aa, Homo sapiens
MIRIELVPPTSPTGHQPDVCLPEQQAEEEMNNLGRRPVGLVG

SEQ ID NO: 1023834 - protein, 226 aa, Homo sapiens
SGAEWLVVPVAAWFEVAVEYDSAEFISLGIPVLTSLRLSVRMSARGPAIGIDLGTTLFVRRGLSNMATVEIIAKRPWTIRTTAQLRGLHGTPERLIGDAGEEPGGHESPILDTHHSTAKRLSGRKFEDATVQSDMKHWPSRGVSEGGKPKVQVEYKGETKIFFPEEISSMVLTKMKEIAEAYLGGKVHSAVITVQAYFNELASAQANQRTPGTITGLNVLRIINEP

SEQ ID NO: 1023835 - protein, 290 aa, Homo sapiens
PAETAAGARNFLLELSTSGFPLHLFTVPTLGDAFSPPEENLSFFFLLFPFSQPGALHWGRGDFKSWPGGTPSLPPYTVIPYLLVRGCFYNPLYWLGPGSLSPPCPAPQARKDVVGENGCGRAWLIVALYRLISYSCGGVKRMPLETVVLPAKAWGDHVQREKGPHSPGGAGEGTRAFSLAAAKFRRSRGPPERWSSGAELKNAWRRQRTDIRTNGHLSAITNICRCGQPRRRLYQKAKARRAKAWGDITHPGVNQESAVGPRWKSRREQGTRMPPSMARHTHTRGQTGTT

SEQ ID NO: 1023836 - protein, 74 aa, Homo sapiens
NLHEGIPAGIAKIYSSAKIYSSAKIYSSAKIYSSAKIYSSAKIYSSAKIYSSAKIYSSPRFTHRQDLLIAKIHF

SEQ ID NO: 1023837 - protein, 206 aa, Homo sapiens
TSFHPGTHRLEAGPDMASPPWQPDLSSRQCSVCSTCTHNSMHNTVFHSHIHSAGHQPTMYRPLVSMHQEAGSQQQVGCSEQATQEDWSQCTLPASRTPLWQPVPRLCCTLCHELVEDTHFVQCPSVPSHKFCFPCSRQSIKQQGASGEVYCPSGDKCPLVGSKCPLGLYARWKFATSLLEHVNSDKKESRLVTFAGFSKEPMITLN

SEQ ID NO: 1023838 - protein, 122 aa, Homo sapiens
MSGERGPRSWSETRSCRELDDRAECNIQAREAIPDFEHKRSHSIKRKYWLEKTIKDDDHLGSDFAAIILHHSSEAELADEKLAGDPFPLDHGFPQLDSSDFWTRSVYRRSLYETSFSAKNAI

SEQ ID NO: 1023839 - protein, 125 aa, Homo sapiens
MELQAMESKGSHEKPENPVRTVGEALRTYTAGKNVDFTNGREELLRSRFMEHDSSHGNGDPKGSDELYLDGTYTPLINEMNRIEIKMEVKSKKVCRQEQNPYSFEARYSMSAEPFLSVVEDEPFI

SEQ ID NO: 1023840 - protein, 108 aa, Homo sapiens
MAPDAEGSAVMDGSMPRGASGEETAEYRQWCNKCTFQTTEYHLSHLANVILPVTMGNPVEIGDINRMWDKRKGETKLPFGNPTQREYKGTYISQSINGITSLAMNVGL

SEQ ID NO: 1023841 - protein, 143 aa, Homo sapiens
VLVEVTSSLNPAWQSLTHRRDAQGRQGDLDHIYLICIQFWDNVVTDAIVLRSGACNLMRSSSTEHTLKLLLYGMCCVTEDSLNQLCCIVHCCVLCMPVILCSHLSGKNSLSLVSHKLSHDLMSDVNEHGQTCDVFPLWCSVSG

SEQ ID NO: 1023842 - protein, 237 aa, Homo sapiens
MDGFLGGGDGGLFYFFFWGQGLALSPGLECSGRDLGSLRPLASRVRAILLASASWSGWEIGGVRWPHTPGLDFLVFMGKKWEILANVWAQAGVSELLGLQVIHPALAVPEGAGNVQALSHTHRGAVVIYFNVSFITLIEDHLCKSLGISQSFLFHVNVRPANLIYSSLKGFVVDLALVSAHLVSSLIPLTVICLRSIGPFKVASPEQKKIGVPEVQKATFAYRMGVHTCWVCKFHQL

SEQ ID NO: 1023843 - protein, 553 aa, Homo sapiens
MLSVRVAAAVARALPRRAGLVSKNALGSSFVGARNLHASNTRLQKTGTAEMSSILEERILGADTSVDLEETGRVLSIGDGIARVHGLRNVQAEEMVEFSSGLKGMSLNLEPDNVGVVVFGNDKLIKEGDVVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGTDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDSFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVISQHQSLLGNIRSDGKISEQSDAKLKEIVTNFLAGFEP

SEQ ID NO: 1023844 - protein, 112 aa, Homo sapiens
MCAISRFGFWHGIEENGLFQTVSMISRLHIFYTATHMSKMLGSSDCHLRTSQREDTEKLCLFLRNTEVPWSKLPFFCNNVISNALNSSTWLCFRKHSSVFSVFVNLSSSGRW

SEQ ID NO: 1023845 - protein, 375 aa, Homo sapiens
QYLLQLNNLADRSCNDLSQYPVFPWIIHDYSSSELDLSKSEEPSVDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVANGYATSWKLGKTPKQLFVTHILRRITPKFNKKSKSSSYNASMADPQVKSLLEEPERRKSNNTDLDIISPKACRYNEHVLQIHYRSKYMVSRVSRKDLQVFRNSKDSLENVSKESNDTPSYSSQRCVLLVTLHGIA

SEQ ID NO: 1023846 - protein, 105 aa, Homo sapiens
AGQNLRCSAGDWQDAVQRADFRDAGFFFLLECKYQSRYIEIRRSYSVGEAMEELLPDGQIWANMDPEERMWQLLQLLPTSVQGRVKEMSGEKPNLSNMIPTVKLQ

SEQ ID NO: 1023847 - protein, 78 aa, Homo sapiens
CPNKWIVAKPSSSFLRHRGVFLTPLLAMSSHKTFRIKRFLAKKQKQNRPIPQWIRMKTGNKIRYNSKRRHWRRTKLGL

SEQ ID NO: 1023848 - protein, 78 aa, Homo sapiens; identical to SEQ ID NO: 1023847

SEQ ID NO: 1023849 - protein, 259 aa, Homo sapiens
NRERMQPGVELGQARCTLVRLDMWTMSLQGLVPDDRLLCCAVLCCREMTAGVTSLCPPCPPLLLCQLGALSQSTSGLLAVYLAELSFLLSARDETQEDSSSTMELYWKLKWSELSRAVVKPKGESVTGTSVLVATERNSEPEGRGHRTVQLRELGSASRRGKQLSAEASERTRTGVFAVPAVPNGHLTSRVKLGSGSGRGGGSAMEGSQGRRLDMLQGKVKRSGWRSAGPRWAMYGDIFYLPRGVPEAAGRQRCLAQEP

SEQ ID NO: 1023850 - protein, 258 aa, Homo sapiens
MSPEGSECTSRQHESRGAVTISDQKPWSGIVPDDRLLCCAVLCCREMTAGVTSLCPPCPPLLLCQLGALSQSTSGLLAVYLAELSFLLSARDETQEDSSSTMELYWKLKWSELSRAVVKPKGESVTGTSVLVATERNSEPEGRGHRTVQLRELGSASRRGKQLSAEASERTRTGVFAVPAVPNGHLTSRVKLGSGSGRGGGSAMEGSQGRRLDMLQGKVKRSGWRSAGPRWAMYGDIFYLPRGVPEAAGRQRCLAQEP

SEQ ID NO: 1023851 - protein, 335 aa, Homo sapiens
MKLKLKNVFLAYFLVSIAGLLYALVQLGQPCDCLPPLRAAAEQLRQKDLRISQLQADLRRPPPVPAQPPEPEALPTIYVITPTYARLVQKAELVRLSQTLSLVPRLHWLLVEDAESPTPLVSGLLAASGLLFTHLAVLTPKAQRLREGEPGWVRPRGVEQRNKALDWLRGKGGAVGGEKDPPPPGTQGVVYFADDDNTYSRELFKEMRWTRGVSVWPVGLVGGLRFEGPQVQDGRVVGFHTAWEPNRPFPLDMAGFAVALPLLLAKPNAQFDATAPRGHLESSLLSHLVDPKDLEPRAANCTQVLVWHTRTEKPKMKQEEQLQRQGQGSDPAIEV

SEQ ID NO: 1023852 - protein, 104 aa, Homo sapiens
MWKIVPKENKVVEKAPVAEVKPPFKEGGEYQGAVEEIVNGGLGLPPWPRGFGRRMCPHRAGRITFAYDRLENGDDYGTGLSGGDEKSYRRKIRELQLEVQSAHS

SEQ ID NO: 1023853 - protein, 384 aa, Homo sapiens
MAAPGRRLPGCRASWCRRPSNDLEALRALTALFTEQRNRETAPRTIFQRVLDILKKSSHAVSLPAEIIPSGKPGFQSAVNNRMLQGVFASACIECSVNQNSIRTLGIRLVSAGGFDFISVPGTGKVEQDSLLTALTLWRLQIQIGNHCLNGNEDSQSIVWVHAFPELVPGLAITSSGQTEIVAYSSKLDKMYIPLNHDKTLKELEENLKYLALDVTTTACTKNILNQNGRSVTITDLISEKPGLGYKAMFTKLNNQRKKYHCKTLMIAKDNEDEPLTKDDIPVFVRHAELMQSTFVDQCKTVLKLAHEESLLMMRKALGTIGSRKSGGNDGILDCRYIEEFPVLEEKDFAGTQRREKTKLQWGIRQGYPGTGNIYTRKVHNNTK

SEQ ID NO: 1023854 - protein, 50 aa, Homo sapiens
RVLPEGGVATQLFTLTVGDVGAGGRRMAKQKRKVPEVTEKKNKKLKKASA

SEQ ID NO: 1023855 - protein, 151 aa, Homo sapiens
MTPGSAGVYLPVFPPSETGVALAFWRSEPNKHKKGIAGLDHCSPMALLLCPKLTLTHLPLLQLPAAHSNFCSHVFIFRSAAGSWTSERRGLDIRWQTHLSIFLVGPGSSYIWFLLLQDSFPSPCAHSSVSAPGSSHYTETSCICGISPIIN

SEQ ID NO: 1023856 - protein, 231 aa, Homo sapiens
MGPASPAARGLSRRPGQPAAAAAAATIAAASARAARHREPGRWEPRRGRGPGVGPGGWTMRAAITLQPGPDVTWLVVGNRKTTTWRLYDLCVYRGPRDAAVPGRYIAGQRKYPRKSDKIWARSSDEQGYGKGAIPHMGRRHELRRGFTRKAGVHGDTQNTPTQRKGLCHHFQTCTCPGVETFLVKVTCAHGMGVALERCVARMSFGTRGSGQCGPKMSREFPHPREGIQGN

SEQ ID NO: 1023857 - protein, 273 aa, Homo sapiens
REPVTAGAGPGGSAGDVRAQGPGHGARQPRCSRSKSPPGPACRCRCCCHYCCCFCARSPPSGAWPVGAPARPRPRGRPRWLDYAGSHNPSAGTCAAGLLGYQTPQSLSDAVSGTRSRVLEYCRQMYPESVEIARVEHGYERAIPMELLVLGVPGGGELRRQTLIDHGCARIRVPCLVTFVSEALLAVLKAAVFLHQERSGTNVTVQTAEAFREAQEALQAPQGPHAWHRRRGIASYPVASDRFRVCEYCVAGPLQGTPTIWDSSLVTLNRSWA

SEQ ID NO: 1023858 - protein, 48 aa, Homo sapiens
QTSLTHCAYAGSIITEKPLCCAGWQACGCWLRVLLSCGTPLKCSSLRA

SEQ ID NO: 1023859 - protein, 56 aa, Homo sapiens
SCPPVDLVKTRQVVTGAKFHFDAKFGSFFDIASPQLIHALEELILGFLSAVFVAQR

SEQ ID NO: 1023860 - protein, 175 aa, Homo sapiens
CQLDLAASTLKGFFDLIAVVAGVVQTILYCDFFYLYIDKSTQGKEAQFASISAKDHHQHLSFRVLGQNSYHSKGITRPKTKKRGGNRRRTPERKNNTKTPTTGSGKQEARRGGEEARKTGGETNKRKRGRKRATGKAQTEKTQQGRTKNAKGGGEGKKGGQKRNGCVVVSQSVVV

SEQ ID NO: 1023861 - protein, 85 aa, Homo sapiens
CQLDLAASTLKGFFDLIAVVAGVVQTILYCDFFYLYIDKSTQGKEAQFASISAKDHHQHLSFRVLGQNSYHSKGIRCLIRKIRNR

SEQ ID NO: 1023862 - protein, 124 aa, Homo sapiens
DLEDPWVLIPPGPATKASSFLLEKKGESSRKHRYPQSMWEPEGKELQLDQEERAPWIEIFLGNSTPSTQGQGKGAMGTQKEVIGMEAEVTGVLLVAEGQRATEGTHNKGSRVESRPEAADAQPQ

SEQ ID NO: 1023863 - protein, 120 aa, Homo sapiens
ATPASPSSAPTLRASATASCGDLAFAAKESLVAAESGRKPYTGDRRHPIFFKRKLDPAEPFAGLASSALSVFETEPGGGGMRWFVDTAERYALAGRPLAELCDHNAKVARELGRNQVGRC

SEQ ID NO: 1023864 - protein, 183 aa, Homo sapiens
MSFPSPWNFGLVLGNNIFLKVGLIGGSGNLKYPNGLFSSVGVNPKSSHLLWDVPGAGTGLESFSGTVGMYGASILEAKRVGEWARNQSRAQDIPAGCIVWKLDGPGVWYTGLPLVGVLALAWLVASRQAPVLADDTLSSYPGNPKGQVGSNWWENRVGLHLGTHLVLSLPSPQPQSGTVNTCS

SEQ ID NO: 1023865 - protein, 362 aa, Homo sapiens
TDPDHSVVLDPTWGRIHDEDAGRTLRGHLAKIYAMHWVTDSRLLVSASQDGKLIIWDSYTTNKVHAIPLRSSWVMTCALRALRELCGLVEGLGQHTSYHTTASRPAQGNVQGTAGETSTGHTGYLVRVSRFLDDNQDDITSSGDTNWCPEETLRQASRQRVKLDTGGDVKSPEPWTPMADTSGVQSGTMMPTIKTDERTLREYTDADQTPIGQESDIKARGQTTNKGKPKTTGTDEATERHYDRGPEQHPHDSMDKSQGNTNEHSKTENAATRVTSQRTHQNDEGAKTEPPVTTRNHRGTSSQQWQTLEPTTQGHRPHGGPRAQHLKKKNTSHRAEIHKHLHEWLSTCNNEQQAPPNPPNRR

SEQ ID NO: 1023866 - protein, 136 aa, Homo sapiens
FPKPNSLGRNNEEERSQKEAEAAQRWPGEKAQASSIPVGSRCGGGRRNNSSRGTVMYVGLTDFKLGYWIVVRYDEPLGKNDGSVNGKRYFECHGESMGALCPSQTVVDGGGSYPERRIYRVGREYEHLKKFPCFSS

SEQ ID NO: 1023867 - protein, 115 aa, Homo sapiens
MPHCGLVQALEAQVRPDEERLRPWGSGLPGWAHGWMQEKEEPVFNVPTSVMMAEMTLRLTTWEHACSERLTAAMALSYSAGTPPFIGWVTLDEKRMSHVFPEIIQWPHRRICKSR

SEQ ID NO: 1023868 - protein, 218 aa, Homo sapiens
MVILNLRARFRLVFRQNLQAPPPHPSIYMNHSSSRDGARNLHFLMRSLGNASDALKLGTTVLGQSQQQLRSSKLHGSNRSLVSSSEEADMQRLHMQVHIHLGLHRHWLSTSRAPKTPFLSPCELIDTFRVWGTCLLPILSQKASPFLSSPSCYTWLASHPIFLEPQRTHPPFIHSFIHSFIHSFININHNLSCMCQAQGIPSRDNLPPRAHGLVEETD

SEQ ID NO: 1023869 - protein, 283 aa, Homo sapiens
MPFSGESNVKEGSGIENLLNTSGSEHVQKPVSSLEEGNTSGQHSGKKLKLRKKNVEVKMYRLRERKGLAYEEVSEPQDDDYLYCEKCQNFFIDSCPNHGPPLFVKDSMVDRGHPNHSVLSLPPGLRISPSGIPEAGLGVWNEASDLPVGLHFGPYEGQITEDEEAANSGYSWLITKGRNCYEYVDGQDESQANWMRYVNCARDDEEQNLVAFQYHRKIFYRTCRVIRPGCELLVWYGDEYGQELGIKWGSKMKKGFTAGRGGHYYDSLKKKEKREFSLRIFIF

SEQ ID NO: 1023870 - protein, 104 aa, Homo sapiens
PGKKGTPWEGLFKLRMLLDYPSSPPKCKFNHHFTRMCNFGNSVPVLQEENKNWSPAITIKQILLGKQELLNPNIQPQEEAYTINCQNRVEYEKRVREQAKFAPS

SEQ ID NO: 1023871 - protein, 281 aa, Homo sapiens
MPRSFLREILHSSHEGPNYRRLETQRDIIGACSACGGLVVPLLPRDKEAPSVPGDLPQPWDRSSAVACISLPLLPRIEEALGASGLDALEVSEVDPRASRAAIVPLKDSLNHLNLPPLLVLPTRWSPDLWAQTVHGAPEKLLGAELDAPSPGAALSAFTATNPTNTLAGLARHRQLATATLQVGRVFTCKYCDKEYTSLGALKMHIRTHTLPCILQDLVGKAFSRPWLLQGHVSTTQEEKPYACSHCSRAFADRPTFGPICKRTQTQEVPGAGLTKTFPDV

SEQ ID NO: 1023872 - protein, 33 aa, Homo sapiens
MTTTTINITTTTSVITATIIVTISTTISITVSI

SEQ ID NO: 1023873 - protein, 138 aa, Homo sapiens
PVARSWVCRKTYVTPRRPFEKSRLDQELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVLIRQRHISLWS

SEQ ID NO: 1023874 - protein, 361 aa, Homo sapiens
FSPLPVSNLCSGGSCSPARTPPATQDLRLPPPPLANPSRRPSLRKPGRLSPLRPRRVKVTVCKEGGNEWEHGHERRRIHLELRNRTPAAVRRTCLWTTCKSNDGQNCRDLTADYVNLEFLSLNKCTGLISDIKYSPSCLHIETQLDTQMKIEYFGGLDMSAEKLPNSHTSKLKLDNKPDQISDTVGNFETSQDMSETAWNLLNCEVTKLQMPKRRRVSSKTSYPNQDKQGMATAPKKRTRKHLYYRLTKYGKAVALKKRKTTNRRRMKQRPERTKQHKRKKKARRPPNHRTPTAETTREYEPNNNTKRQRQTRTYAKTYATHEKEKQTKKTEKEKTDKTTSTHSQPAHTHQNDTNKQQNCD

SEQ ID NO: 1023875 - protein, 176 aa, Homo sapiens
LQGPSGIDCAGPLVRRALFLVISSKRDGRPIVRYTHLTNVRESSRLSQDTETEAGADEPTQLAAVLAAAVGARCECWLDLLLQCIRRARHEWSVTGVSAPTVTVFISSSLNTFRSEKRYSRKSSAIAEFKCKLELLVGSPASCMELELYGVDDKFYSKLDHEDALLGSYPVDGCPI

SEQ ID NO: 1023876 - protein, 249 aa, Homo sapiens
ERVLSVLPLPSPGSQSSPRSSDGTMYPGSPGPLLCGINSNGWRLQLPEQQPQHQGAMELAAATVGSSLRHPDPHSQPPLSTGGGAGAVGCAVQLTVQLARGCDYNSVTLQVFYCMGFCHVNVRPTCLLLLHAPPLTCPVYVVRCATGILSARMGTGSPTGRPACMILTPYGKAFEHTDMNAICLHAAYTTTMFTPFAGFPQCPLTQIACDPSCSDTLTYPGDTSDVTEHCTTFCNLYGATCTNDSDLCA

SEQ ID NO: 1023877 - protein, 40 aa, Homo sapiens
SCIMDVSKGKVCSEMKVTEKIPVRHLYTKDIDIHEVRMAG

SEQ ID NO: 1023878 - protein, 314 aa, Homo sapiens
MGQQLSWEEAEAAGEMDVAELQEWYKKFVVECPSGTLFMHEFKRFFKVTGNEEASQYVESMFRAFDKNGDNTIDFLEYVAALNLVLRGSLEHKLKWTFKIYDKDRNGCIDRLELLDIVEAIYKLKKACRAELDLEHQGQLLTPEEVVDRIFLLVDENGDGQLSLTEFIEGARRDKWVMKMLQMDIKPGCWITAAEAEKRLVLRAKDPSGPNPSKILRVPELLAGGLVVKTCSRGVDSARANKVRTPRGQNSLRNLLVGPSTGQWPGKGQGRGHTNRSQKAERGPRERRKAGVATPTHTEETTTTRAQPRRGGPT

SEQ ID NO: 1023879 - protein, 256 aa, Homo sapiens
VNPPAEVSTSLKTYQHFTLEKALPCSEGVLLGTFTPAAGDFMRFRFFQPLRLERFFFRSGNIEHPEDKLFSTSVEVLAFDNPQSDKEALQEGRTATLQYPPSPDGYLQISSFYKGVAEGEVDPAFGPLEALRLSIQTDPPVWVILRRDLPEKGLTKLRASEGTLWPALKPSISGGVVSCRPRRAQIRPRPKGSAWRRAGAGLGSAAGPEALGAGAAPARRAAEEAGGPHTVPEARNPSHPACPTHPLEELLLGRPP

SEQ ID NO: 1023880 - protein, 85 aa, Homo sapiens
RGDPRARREIGTEVSRDAPKSPASLDGFQFSQVTLLAPQLAVTSGPPWHHTPQSPGTAAPALMVLKLSVMHHGVCVHTVINGLLS

SEQ ID NO: 1023881 - protein, 223 aa, Homo sapiens
SGVAADAVPRLPGHSSSISLAGSSLGLRPWSPGPVDPHSLGAPQPSLWSQRGGTKASHAQVYKHCPNFFKSHQVPAGCSGKHGSHGLGYRPLPHSSCFGLCPQSPSRVTNRDGQQSGAHFLRQPGDGDELRHQCPRSLRLRAGYPSAGKGPVQGAPRGLHAVHVAGGPAAGLDATLPSQQVLPVAGSWALGRGGPWLSVAEHVPLGQLLGLSCLPALPRTPST

SEQ ID NO: 1023882 - protein, 194 aa, Homo sapiens
MENPSPGLHDLGKAPLLLLLLATLERRTGQTSWRDESICSARAPAKYSITFTVQVEPEAFPKQYPLFLPPCCSGLLLAGGRRIAPDYSMWMEEPGTSVTWLRDFACCAVPMAWAADEVRSRRRGMALAELCTLGVFGLPCLSPAVHRGRRLAETLEVQRRHSAGLRLWLRIVAQPPDLVLWAVGQAWTLVRPGD

SEQ ID NO: 1023883 - protein, 654 aa, Homo sapiens
MPRPVLSVTAFCHRLGKRESKRSFMGNSSNSWVLPREEAQGWMGQAVQGGTRTSRSHASFPKLELGLGHRPSPTREPPTCSICLERLREPISLDCGHDFCIRCFSTHRIPGCELPCCPECRKICKQRKGLRSLGERMKLLPQRPLPPALQETCAVRAERLLLVRINASGGLILRMGAINRCLKHPLARDTPVCLLAVLGEQHSGKSFLLDHLLSGLPSLESGDSGRPRAEGSLPGIRWGANGLTRGIWMWSHPFLLGKEGKKVAVFLVDTGDVMSPELSKETRVKLCALTMMLSSYQILNTSQELKDTDLGYLEMFVHVAEVMGKHYGMVPIQHLDLLVRDSSHHNKSGQGHVGDILQKLSGKYPKVQELLLGKRARCYLLPAPERQWVNKDQASPRGNTEDDFSHHFRAYILDVLSTAPQHAKSRCQGYWSEGRAVARGDRRLLTGQQLAQEIKNLSGWMGKTGPSFNSPDEMAAQLHDLRKVEAAKKEFEEYVRQQDIATKRIFSALRVLPDTMRNLLSTQKDAILARHGVALLCKEREQTLEALEAELQAEAKAFMDSYTMRFCGHLAAVGGAVGAGLMGLAGGVVGAGMAAAALAAEAGMVAAGAAVGATGAAVVGGGVGAGLAATVGCMEKEEDERVQGGDREPLLQEE

SEQ ID NO: 1023884 - protein, 235 aa, Homo sapiens
RAAPGPQIEAASPSQPAAHSVALPRPAHSCLCRSCSRAGVRAGGLGGERRRPRRRQVRGGRKRLARRAQQLRRLARFLGVSVRRVGWGGSRGARAGEGVTGPAMADNEKLDNQRLKNFKNNMAADLETMTKTTTLKLYVDTYTDELQTEMTPSLKEKAMYHHEDICEDSDIDGDYRVPQLPSLEAIVQKCFHIDKPRNSIKVQVQSCLGRLLSKCIDNPPKLSDFPTPSGNIGPF

SEQ ID NO: 1023885 - protein, 61 aa, Homo sapiens
PRPGRRWCGGRRYGHWCWAADRRARKGPRPRISVCRCSSAACAMASSAASSEHFEKLHEIF

SEQ ID NO: 1023886 - protein, 162 aa, Homo sapiens
GLPSPAELWVNYTSFLYKLPVLSMSLQQHENRLIQTLSPIPGPDSYIYSIPLNVIRFSPFFTVTTSILAHSSVVLITADADFQDVNLILLLPCLNLQWLPTALGIRYLLLAWLVRRGLAWLLLPASLCPLQALSASLTPWSSHTCGLARVSLTLGWSHKQAE

SEQ ID NO: 1023887 - protein, 330 aa, Homo sapiens
MRSHTGLRALVAPGYPLLLLCLLAATRPDPAEGDPTDPTFTSLPVREEMMAKYSNLSLKSCNISVTEKSNVSVEENVILEKPSHVELKCVYTATKDLNLMNVTWKKDDEPLETTGDFNTTKMGNTLTSQYRFIVFNSKQLGKYSCVFGEKELRGTFNIHVPKAHGKKKSLIAYVGDSTVLKCVCQDCLPLNWTWYMGNETAQVPIDAHSNEKYIINGSHANETRLKIKHLLEEDGGSYWCRATFQLGESEEQNELVVLSFLVPLKPFLAILAEVILLVAIILLCEVYTHKKKNDPDAGKEFEQIEQLKSDDSNGIENNVPRYRKTDSADQ

SEQ ID NO: 1023888 - protein, 337 aa, Homo sapiens
TGRDTRGFRLLPHWKITPQASLAPSSELTGMVPREAPESAQCLCPSLTIPNAKDVLRKRHKRRSRQHQRFMARKALLQEQGLLSMPPEPGSSPLPTPFGAATATEAASSGKQCLRAGSGSAAMQQKACSRESLRALAQQMCGYRTVKMVGKGPRGRVNELARCSIVSYHGNVLYVQDTSGRENAHSDIPVPRGGGTHFWQTHCRQGVPLSTVGPRKEDPLKPLKGKGGGGGTPLHNLSRSLKYVPPYGAQSPGITTYVPKLPQRSPGLPQPRARGLSKWTALQAAAAKKIQVGQHGHSSVEDATTAMELYRLVEVQWGQQEAAALDLPEDRELQTDM

SEQ ID NO: 1023889 - protein, 137 aa, Homo sapiens
MAGIFKEFFFSTEDLPEVILTLSLISSIGAFLNRHLEDFPIPVPVILFLLGCSFERIKLYIFTGPKIRKRHTMDESRLIFSYIYTSSFSLLLHLTWIRTCFKQLILGRYLLTFNSRLFGYIILLRSLASGICNINYF

SEQ ID NO: 1023890 - protein, 309 aa, Homo sapiens
LPQDVAEGCWSGCTLGLLVGSQLAVMMYLSLGGFRRLSALFGRDQGPMFDYSHPRDVYSTSSVTCLGPPGGPHSFLKGLPYLSRNGFSSSLDGSLCRVSFSPGAKSRGSMIVDAGSPRSRTKGARYRACRVVSRRFPNRPSLCLIVPWEHLPCVLLAPYSNLLPLACSAEASLVLMASMSIHQGWKMDTFNRAKLLNVWGCERPCVMNEWGLPVLDTMWTSCQKNEQQSCMCVSPGVPPAYVSRRYEATLWIPGSRSPQYYGWSLKHLLLNRYLRDAMASPMNTGAGGGEEIDDIATRVRLGGMKISRP

SEQ ID NO: 1023891 - protein, 52 aa, Homo sapiens
ISLHVLISLTRPHLPYRLISLTVLISLTVLISLTSTSPYTSPRSLQFPMNKK

SEQ ID NO: 1023892 - protein, 124 aa, Homo sapiens
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNAPPVRTENRLIVENLSSRVSWQVC

SEQ ID NO: 1023893 - protein, 124 aa, Homo sapiens; identical to SEQ ID NO: 1023892

SEQ ID NO: 1023894 - protein, 39 aa, Homo sapiens
SGVERYLGAAAHGCGGATVRDALFAAKGRAADCESPREF

SEQ ID NO: 1023895 - protein, 239 aa, Homo sapiens
GRARAPQTPRARSSGPAAMARSVRVLVDMDGVLADFEAGLLRGFRRRFPEEPHVPAWKQLHAGLPGAAEAVPASPADPDLADKVAGVYEAPGLFPGPGGPSLGALDAVREMNDLPDTQVFICTSPLLKYHHCVGEKYRWVEQHLGPQFVERIILTQGQDGGLGGTCSLTDKAPSQRPGRRPQAWEHILLHHAATIGTWSCPRHGDGCSPGVTNWREILDSKRGAAQAAMSGDAGAAAES

SEQ ID NO: 1023896 - protein, 90 aa, Homo sapiens
MKHPIRAKLQIRYVTSQQGICGDFRGKNLAVIIRTEEIGQFKPSFQTSNALRNTDVKENNQKNGLWTVWKNSEQDPRVLSENLKDGDKDF

SEQ ID NO: 1023897 - protein, 82 aa, Homo sapiens
SRGSPFQTAPQQIAADIPRSGCFPCMGRRAWIAKHPGSRNKHGLLLQNTSVHRRRTSLWNLHLPGKTLGILLLSLQKKKNEL

SEQ ID NO: 1023898 - protein, 59 aa, Homo sapiens
SSSVPSSPYRQRFCAPISKPRAHWISMAVLLNPINDHQLKRGYAVVSHTSIYGERLHFL

SEQ ID NO: 1023899 - protein, 333 aa, Homo sapiens
AEWLQQPRGWGAPGRELDVLASGRTLRALRVPDAKHREHPVSGASGERCPMNVRGAAPGVLRVPASLAIPDFPTASRWQPRSRTMFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKNSTSW

SEQ ID NO: 1023900 - protein, 292 aa, Homo sapiens
AEWLQQPRGWGAPGRELDVLASGRTLRALRVPDAKHREHPVSGASGERCPMNVRGAAPGVLRVPASLAIPDFPTASRWQPRSRTMFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRSLKEQPMDDNIFISEKSEPAVPDLFPLYLEMHIVVDKTLYDYWGSDSMIVTNKVIEIVGLANSMFTQFKVTIVLSSLELWSDENKNSTSW

SEQ ID NO: 1023901 - protein, 87 aa, Homo sapiens
LDEHGISGALEGIVNRRRGGRGPHTRITSLGYPYYLACRSADYEHTHVRRITGEYSCSEQELRSREMITLALEQTNKYMFQSCVLLL

SEQ ID NO: 1023902 - protein, 365 aa, Homo sapiens
MGTTVIKEVLQRAKVAPEEVSEVIFGHVLTAGCGQNPTRQASVGAGIPYSVPAWSCQMICGSGLKAVCLAAQSLAMGDSTIVVAGGMENMSKAPHLTHLRTGVRMGEVPLADSILCDGLTDAFHNYHMGITAENVAKKWQVSREAQDKVAVLSQNRAEHAQKAGHFDKEIVPVLVSSRKGLTEVKIDEFPRHGSNLEAMGKLKPYFLTDGTGTVTPANASGMNDGAAAVVLMKKTEAERRMLKPLARIVSWSQAGVEPSVMGVGPIPAIKQAVAKAGWSLEDVDLFEINEAFAAVSAAIAKELGLNPEKVNIDGGAIALGHPLGASGCRILVTLLHTLERVGGTRGVAALCIGGGMGVAMCVQRG

SEQ ID NO: 1023903 - protein, 303 aa, Homo sapiens
AGLPLPGCVAGASSRASNCPVTTNCHYSGWDPGLQAMWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEPQQDFAKYIEMHVIVEKQLYNHMGSDTTVVAQKVFQLIGLTNAIWFPSNYYELFWLHWELWIRLTLKLATLEKVMRFSPHFKEGKNSYPGEGPHEV

SEQ ID NO: 1023904 - protein, 103 aa, Homo sapiens
VTGTGGPGRNAPVLLAGPLCRSRQPGLLPRSAAAIHQPGPFCGRAMPLPDTMFCAQQIHIPPELPDILKQFTKAAILHPAGRRAAGGPRGYFSGSVEQEIHFL

SEQ ID NO: 1023905 - protein, 103 aa, Homo sapiens; identical to SEQ ID NO: 1023904

SEQ ID NO: 1023906 - protein, 88 aa, Homo sapiens
SDNLEDPERVMRLKKPGCASAVIVLLVEHWRRGHPVLSCGEHCPCPRLLPKAMHWCCTTVLASRMDVRLTLCETVVARDAVRAEHEGT

SEQ ID NO: 1023907 - protein, 106 aa, Homo sapiens
HSTLVAATYVQCGGDLAPRGGYSLTQGPVTLLCPVCASHKVAYSNDSAWTEYQDPRTGSSKIFPGNWDNHSHKKNLFETPILARYVRILPVAWNNRIALRLELLGC

SEQ ID NO: 1023908 - protein, 106 aa, Homo sapiens; identical to SEQ ID NO: 1023907

SEQ ID NO: 1023909 - protein, 127 aa, Homo sapiens
VSSVLEVSHVFCCPNRVRGALSWNTGPGGLLAFGTSCSVVPYDPQKKVVITNLNGHTARVNCLQWIRTEDGSPSNELVSGGSDNRVIHWELENNQVLKSVLSKAMKDLFVLCTLFTRVGHPKGSSMR

SEQ ID NO: 1023910 - protein, 144 aa, Homo sapiens
AGLQMENDGRRGAAGASAPAPGLDLRGHLTPTCPGRAARGVKSGPGSGARLRAVGGGVPEFCPSQLQAPPQLPSPASHPPGGGATLGTETDPRVGDAGRPWAGDPRVEWAGRLEALGLRTAGTLEPGDTGIAEAVTPVATNVWT

SEQ ID NO: 1023911 - protein, 155 aa, Homo sapiens
MQDSVVGGKTRQVVEQLGRVPPVVFAPEDVVSPKNLRFHTGAWQNFTGPVLDNRTHKRIEVGRLVGTPLRDSSLLCTKCQDPLLFTLIRMLADGLLTSVRPETLDGVLQKWTGEIRELGPNTKRLWAAASLIGGQMVTYIVESYKSQEEPRVLGP

SEQ ID NO: 1023912 - protein, 151 aa, Homo sapiens
VLENFMSSPPMSMSALFLFTHITNKPGRKTFLGFLFISRFFLFLRMSDEEQSAIVCDNGSGMVKAGFSGDDAPRHVFPSIVGRPKNEQAMMGSASKKLLVGDEAQAKRGVLSLKYPIEHGIVTNWDDMEKIWHHTFYNELRVTPEFPQRPN

SEQ ID NO: 1023913 - protein, 106 aa, Homo sapiens
MSDEEQSAIVCDNGSGMVKAGFSGDDAPRHVFPSIVGRPKNEQAMMGSASKKLLVGDEAQAKRGVLSLKYPIEHGIVTNWDDMEKIWHHTFYNELRVTPEFTQRPN

SEQ ID NO: 1023914 - protein, 247 aa, Homo sapiens
SGCFSPGKAGALGSLQVQCPPVGRTLATSPRACLYSPIMKGFGKRTSPRRSGDHGLGTPGRDANQLAAQRHTGLTMSPLTGTLSTLLSGPAPTSQSSPLTSFLTSPIAGPLTGTLASSLGLPSTGTLTPSSLVAGPVAMSQSSPLYSPCDGHGGCLSEAAPSSAPLVIPPGVSQNLLAKPMSNLVLPRGPKLRLAEPLRGGPTGPQSPACVVPNGTPKSQSPLSPPVNPGPKLFKWRFAGKPSKIPP

SEQ ID NO: 1023915 - protein, 317 aa, Homo sapiens
SGCFSPGKAWGPGQPPGAVPSRGPHPCHSPQGMSLLTNYEGLRHQIERLVRENEELKKLVRLIRENHELKSAIKTQAGGLGISGFTSGLGEATAGLPSRQNNGVFLPPSPAVANERVLEEVGIMALAPLAEMLTSLQPSATPGSLMSPLTGTLSTLLSGPAPTSQSSPLTSFLTSPIAGPLTGTLASSLGLPSTGTLTPSSLVAGPVAMSQSSPLYSPCDGHGGCLSEAAPSSAPLAIPPGVSQNLLAKPMSNLVLPRGPKLRLAEPLRGGPTGPQSPACVVPNGTPKSQSPLSPPVNPGPKLFKWRFAGKPSKIPP

SEQ ID NO: 1023916 - protein, 281 aa, Homo sapiens
NGHRVLQSECRLAWRALAPRSLGLGLEPGEVLVMLGLCPGTAVAEVAAAWSLGSQAAQGSGTAGAVFLRVSWGPDVMAAVLPPVPESCTDGWPRSPVAAGAALHYLGSFSLQTLCVLPTLALPVPLLPWDNHCLLATALFTETPHDMTALDVADGLLEIGLLLPADSGSPSYSLGDPVVVLYWSHRDWTDKQAWASNQLKASQQEDAGKDATKISVVKVVGSNISHKLRLSRVKPTDEGTYECRVIDFSDGKARHHNGQGATLRVQSQGENSRPASAPKAT

SEQ ID NO: 1023917 - protein, 155 aa, Homo sapiens
MDYLSGWPRFWVALWAGWPAPGVPVGPPPLFKQLGAVVFQCASGPVLRPWAVCHVGKTPGVEQVKCWDSAFRTERTAREGGRGLEILRGDQRPSCACVAPSPGAAFLREIVTRGCLGQELGSERLHSKAQVPPYSSCVAHTLGPVGWNSGIFPKE

SEQ ID NO: 1023918 - protein, 83 aa, Homo sapiens
RGSREGRERAGEAAEDGVKMAAFSEMGVMPEIAQAVEEMDWLLPTDIQAESIPLILRGGDVLMAAETGQWLNLVLIVFQIIQV

SEQ ID NO: 1023919 - protein, 89 aa, Homo sapiens
GPVGRENLQMPPSVRIPGVQPRPLCFPSTSGVCDKPQFEGLTQWFSRVDDLPPGDTSPCLEDIMWLSWWEPPPAPMCGGGSHDGGLGEC

SEQ ID NO: 1023920 - protein, 113 aa, Homo sapiens
ADYCSISGALSGNSKSRIRAARWPVTAPHSFAFWARGLNRAFQHRHFRRPALPATERFHVLGGLASVCCRPADMSRRVQTRGGYWGHQGVEPAGSVASRPGLGQWVQPSLGLS

SEQ ID NO: 1023921 - protein, 205 aa, Homo sapiens
MIRTLLLSALVAGALSCGYPTYEVEDDVSRVVGGQEATPNTWPWQVSLQVLSSGRWRHNCGGSLVANNWVLTAAHCLSNYQTYRVLLGAHSLSNPGAGSAAVQVSKLVVHQRWNSQNVGNGYDIALIKLASPVTLSKNIQTACLPPPGTILPRNYVCYVTGWGLLQTNGNSPDTLRQGRLLGVDYATFSSSSWWGSSVKSSMVCA

SEQ ID NO: 1023922 - protein, 238 aa, Homo sapiens
LAHVGLTSCCWGIQNRLSIGIGTRDPAMWPVCLDIHLYVPRFREAQCADAMTPAGCTCPSSTVQHLAVPEAEEHLNAGVGMAVTGLFLACCQCLRSLGGYVLSLVHDVRFHHFPIERQLNGTYAIAWWAKRTVDRQSSESYYVVATPDGLDLQDCASLCKRDDEASSRSRGDFDMPAEDAMVRDYVRQTVEAGGAEAPGARPVIKTGTRRVAGSVIATDGPREAECPWEQRASRDGVE

SEQ ID NO: 1023923 - protein, 223 aa, Homo sapiens
MDNDDFFSMDFKEVVENLVTNDNSPNIPEAIDRLFSDIANINRESMAEITDIQIEEMAVNLWNWALTIGGGWLVNEEQKIRLHYVACKLLSMCEASFASEQSIQRLIMMNMRIGKEWWDAGNFLIADECFQAAVASLEQLYVKLIQRSSPEADLTMEKITVDAVTTPECLSYQAESAVVKGIFKRASMCVLHCTDIVDEGPPDELPSPSSTLRYTLLELETPK

SEQ ID NO: 1023924 - protein, 238 aa, Homo sapiens
MISAHCNLRLLCSSDSSASASQVAGTTEVVENLVTNDNSPNIPEAIDRLFSDIANINRESMAEITDIQIEEMAVNLWNWALTIGGGWLVNEEQKIRLHYVACKLLSMCEASFASEQSIQRLIMMNMRIGKEWWDAGNFLIADECFQAAVASLEQLYVKLIQRSSPEADLTMEKITVDAVTTPECLSYQAESAVVKGIFKRASMCVLHCTDIVDEGPPDELPSPSSTLRYTLLELETPK

SEQ ID NO: 1023925 - protein, 107 aa, Homo sapiens
MGIHFGPSLGIFGSSCTRAVKKSKQEICRHKPGSVKGHLVPRSRDSPGQSQEEAKGFLAMLSGGGHQVPSPCTADIAITFLLLLWVVMGSPPGSPQDYDAAWQEGKV

SEQ ID NO: 1023926 - protein, 79 aa, Homo sapiens
FYRIAKVKLEVGQIGEIFCFCSKLSFLLPHTGMIFSALGLVSTWLMLERKGFLKPFHSLYEVISVSENRYLRNSKVKQK

SEQ ID NO: 1023927 - protein, 272 aa, Homo sapiens
REGVRGEATIITTTLQLGSCWWLAADGSPGPRDQEPGGQRCDPKSAAPAPGGLVDRKPRVGTGPPQPTGDRRPPAVFRPPPTNSEDADEEKFVASQESLGSCRNWVNVMNMEYGVYTTRNDTKEDLFIASDVPVKKEISPQKYLRSVGDGETVEFDVVYTERRVHEAVQCDWPGWSSCGVADGYALIGRRIQTWLLWKRAMAIPGITLGGGGRRERQQVKDLPPTTDRQFSGARNRLRRHQYRPQYRQQRFRLTTWDRRLTVAHGSYPSQQN

SEQ ID NO: 1023928 - protein, 85 aa, Homo sapiens
MSKYVNDMWPGSPQEKASPSTSGSGRSSRLSSRSRSRSSSRSSRRDSRSSSRSSSRSHSRPRRSRRSRSRSRRRHQRKYRRYSRS

SEQ ID NO: 1023929 - protein, 104 aa, Homo sapiens
MFNPSAPPPYEDRNPLYPGPPRPWGLWAASVLPSQGIHAYPGYLLGLATCLSLLVYPTARMPPNHYSDAHELRTRAMCIMEEERAVIEYLQQAHEAEIAKYTDN

SEQ ID NO: 1023930 - protein, 103 aa, Homo sapiens
MPRRPGLIHQENFSASWVLLLLILFPGNVRFHRMVNIFPWNRALRMLWCSMMTTIPVCQGMSNFLQFRTFGPKTSTVLDTLRLLVTLEEWRSGGYHSHILVEH

SEQ ID NO: 1023931 - protein, 110 aa, Homo sapiens
AGIELASALLALAAALPETRGAHRRISYLALSSGMTSSAHTSLPGPPSGCQGCCSSTCCAPLPPEPRSTDSRNPLPYRATPCGPPWDQDSEGQATKRIISGQLVSLGFKP

SEQ ID NO: 1023932 - protein, 79 aa, Homo sapiens
SWNRARLGSAGLGCSSSRNPGRPQKNLIPGSLFRDDIIGSHQSSRTTFWMPRLLLEYLLCTSTSWFFISCGPSFQGLSD

SEQ ID NO: 1023933 - protein, 176 aa, Homo sapiens
SWNRARLGSAGLGCSSSRNPGRPQKNLIPGSLFRDDIIGSHQSSRTTFWMPRLLLEYLLCTSTSWYPSHSLKLPACYYGLAKEHGFQEPTTIQSNSLWTPLGSGQRGTSDKEDHQWPASLSGVQTLNQCPSEGALAMALDLCSACVLSLSPFLYICARVHLLVNWSAAFPEEGRPL

SEQ ID NO: 1023934 - protein, 41 aa, Homo sapiens
DTITEVAERVGKSAVQLHLGCCGKLLIPDWGLRWWCWQVTV

SEQ ID NO: 1023935 - protein, 155 aa, Homo sapiens
MGNTTTKFRNALINGDENLACQIYENNPQLKESLDPNISYGEPYQHNTPLHYAARHGMNRILGTFLFGRDGNPNKRNVHNETSMHLLCMGPQIMISEGTLHPRLARPVEDDFRRADCLQMILQWKGAKLDQGEYERAAIDAVDNKKNTPLHYAAA

SEQ ID NO: 1023936 - protein, 48 aa, Homo sapiens
VYDRARYRIRKLGTALELPAFTYSLFKTQVSASPEGLGLLPWYRSLSR

SEQ ID NO: 1023937 - protein, 240 aa, Homo sapiens
TKCRKRKLERICAPGCDNGEDAQGRERGAVEYLPASSGSRWPSSRQKVMTPRQQRAVSLLLWVSMVTRLSELSPDPFTDTPPRLGRLGAHCLPTCGSKGQQSWWEQHHPVDLVGQHDKNQHMDSEHLTLPVTPSPFHTSTDYTKPPLPRLVLWYCLFIPAGNRPRVHIEYNISVYFNRAGEEGAIAAELAPTLVLKPAGDIGEGDPRPPDLPLICTRTVAKRKHALSPLKRSNVNDSVTA

SEQ ID NO: 1023938 - protein, 167 aa, Homo sapiens
MEETGRHHTGGKRGTEGRLRESTGRLLTTFDSRTDEPRRKGERKRESKQAIRRQREHNQTGRTKRTGTTREDDRDRGTRRQKHGRLRDRPNLRANPRGERKKSATRRVHDNRGPPHTVIEVTQRHTQITHHDNDEAREALDARPRTGNRTDDKGRHPRGGDSPHRKL

SEQ ID NO: 1023939 - protein, 50 aa, Homo sapiens
IQATPATTKRPNSRGPLARAPPPAPPPPPPIANAPPLPHQSYYAPPPLPP

SEQ ID NO: 1023940 - protein, 89 aa, Homo sapiens
LEDRQGYITGREISLGGHLQIFLLHPFTMLLVSVDFDVIPKVTEENGEQLPCYFVMVSLQEVGGVETKNWTVPRRLSEFQNLHRKLSEV

SEQ ID NO: 1023941 - protein, 130 aa, Homo sapiens
TRGLNFQLPSTPALPDTMEKVLVLLLVSLLAVAYAAPGPRGLIINLEDGEICLNSMQCKSRCCQHDTILGIARCTHKAMENSECSPKTLYGIYYRCPCERGLTCEGDRSIIGAITNTNYGICLDSRRSKQ

SEQ ID NO: 1023942 - protein, 72 aa, Homo sapiens
DGMMSSSSLFLEVCSLSLGSGTCSPVPKVIALHTCGAGGGGGKASVTAAELWGMFCFTPYAVEVVVVPLGQR

SEQ ID NO: 1023943 - protein, 132 aa, Homo sapiens
AGSPLGVPAPPTSRVARFLSASLHSPSTLSFLSLPSRRTMTRYSTMARGPAPVRPRPLPSFARPGPPGSLVACVTRRPAQSKMEHRGRRPYVECDQAQKGTPEEKRYHPSLCGLVLGMPKECKFIQGSAYVV

SEQ ID NO: 1023944 - protein, 149 aa, Homo sapiens
MSGLPRLWERAAGIRTGSNRWQAVPAEEVLRLQSCLRLAHERLGTNRVFAGGCEGSGPWAAIAGGVERRPVSARPRLLSSSVLGGGACSSVGLSASPWPWALRINGASCLLSLQAQSICRFALGMPRAETMFDNGRGLPVRGPRCALQM

SEQ ID NO: 1023945 - protein, 63 aa, Homo sapiens
VVDLEDLVVLGYRHEHYAGLDTSFNPVNSVPLTATKAPIHRILQSAAHIHLENQQHVHLITSP

SEQ ID NO: 1023946 - protein, 245 aa, Homo sapiens
VAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSLGTVAEITGHQLMSLSTANAKKDPSCKTCNISVGR

SEQ ID NO: 1023947 - protein, 183 aa, Homo sapiens
MLILWTIPLFLLGAAQGKEVCYDNLGCFSDAEPWAGTAIRPLKLLPWSPEKINTRFLLYTNENPTAFQTLQLSDPSTIEASNFQVARKTRFIIHGFIDKGEENWVVDMCKNMFQVEEVNCICVDWKRGSQTTYTQAANNVRVVGAQVAQMIDILVRNFNYSASKVHLIGHSLGAHVAGEAGSR

SEQ ID NO: 1023948 - protein, 41 aa, Homo sapiens
AAAYYYYYCSEFKLLTMYGDMMLIFFQMWCNIYNKICHNQK

SEQ ID NO: 1023949 - protein, 38 aa, Homo sapiens
QPEEFSLASFPSPRREGATSVPFCVLPGQDTLIHTSYP

SEQ ID NO: 1023950 - protein, 250 aa, Homo sapiens
AGLSREGRQAAPASGGGLGDGGGVLSITWATAQLEDGPLGFAAAGEQASGAEAEPGPRGDDARRHSRVLSGAPESPLTAGTSSTTGRRAMASPEGALRHSSSTSELRERCALQYMGKGQTEPTDSWGHQERNPPEQRDFDDWRHGKQAGLHGRPNGSNQCVAWDKPNGTGPKTSDALDRDVGTTTRSPLPLGLLAIDGLMPSLRSHAVANGYQQIGIPSSNRGAVERQSPFTYRGPQGKQSGARRAKTLR

SEQ ID NO: 1023951 - protein, 191 aa, Homo sapiens
GSASAGLAAWCPEEWLLSPRPWSPLAGREPGMPRPRCGACGDVGRAPEALSLGDGSAPPPAPRLAQAAPPFPQHNRALGRFEERGAWEQSITPRFLRVDGGDFQGARKVQARPGLSSVARSPLAVDSGLDPGKPQRALPDPCRVEHLKEKLIEPGPGSETDCDLSWGDTDLDAQHRGPADGWRMSRLTAGR

SEQ ID NO: 1023952 - protein, 65 aa, Homo sapiens
CWLDLNPKSYISIPILRKHSYFMHPRSYTDTTHSTRMNTAHTRAQHTHEHTAHTQTHSTHSTQIS

SEQ ID NO: 1023953 - protein, 269 aa, Homo sapiens
MLRLLSSLLLVALASGCGQPSHNPSSRVVNGEEAVPHSWPMQVSLQYEKDGSFHHTCGGSLITPDWVLTAGHCISTSRTYQVVLGEHERGVEEGQEQVIPINAGDLFVHPKWNSMCVSCGNDIALVKLSRSAQLGDAVQLACLPPAGEILPNGAPCYISGWGRLSTNGPLPDKLQQALLPVVDYEHCSRWNWWGLSVKTTMVCAGGDIQSGCNGDSGGPLNCPADNGTWQVHGVTSFVSSLGCNTLRKPTVFTRVSAFIDWIEETIANN

SEQ ID NO: 1023954 - protein, 315 aa, Homo sapiens
MLQLRDSVDSAGTSPTAVLAAGEEVGAGGGPGGGLAGGGDACCCHDTLCLSASTDPTRLRPAVKGVLLLFLAREASSSAVEEILLWLVAALLEELAEIRVTCGCLPRWITWNNEKDAAGAGHGASPCLSVNYDFISLQCQQVGADSAQRSRHHFLRRIPCFPLNRSTSEKLGIRIQWDKQSRTFLHNQMESLVYQVPYATFTEHPMAGADEHDSISVSVLESFKGLLIQAVKTSQEEGLCQDQANGVLILESPSVIETYVGLMSFHYHEVELGYSITRGTIGFKPLVLGGYSTFPKGTDVGLENWTPASIMLPVT

SEQ ID NO: 1023955 - protein, 34 aa, Homo sapiens
MAADTCGFRGDLVCDEKEGGKGQCEATRPRYPPM

SEQ ID NO: 1023956 - protein, 296 aa, Homo sapiens
MSFFPELYFNVDNGYLEGLVRGLKAGVLSQADYLNLVQCETLEDLKLHLQSTDYGNFLANRGITSDVCQSFDDRLQGEDGGGVPPHEEPLPMMPLASFLDVHLLTVTMIDNVILLITGTLQPAAPSLSSCPMCQPTRQLRGRMEAVKHCFRHLLRLYKWPFWVDTPLAAFYSRTAFPEQDLDEMNIEIIRNNLYKAYLESFYKFCTLLGRDYGDAMCPILEFEAEPRAFIITINSFGHRAVQRGPCQALSTLGGRSYPEGLGQWVRVNDFERVKKVGDITGGQVSPRWGQPGKSWG

SEQ ID NO: 1023957 - protein, 35 aa, Homo sapiens
DQNVTRQTHDLHLTHRKRGAAIEEKLNFTFILYLG

SEQ ID NO: 1023958 - protein, 65 aa, Homo sapiens
SLTPAGQWQDNGETTTQGFGLGCLMRCAQYKKDGADFAKWRLCAEDWGTHPSGLAIMENANVLAR

SEQ ID NO: 1023959 - protein, 149 aa, Homo sapiens
MAPEHNPLRNLPPPQSNNLLYPKGQTRTNRHSALGVPDTCDYQQEADNSCIYVSKITHEVDELTQIIAEVSQDPKLPRTEDHPCQKCGHKEAVSSSHTVRAPEDGLRLYYVCTSPTMRHRGPSDLSIPRVLLKHQDFHEKQPTQTSNNN

SEQ ID NO: 1023960 - protein, 149 aa, Homo sapiens
TLLGTWLKGNVLTAAEAGGWSAEFDHDGTMHEIGVLDVWYRLARLRQNCSSRTRATVAEGRHSSCAAALCRSCGFVAFPDAIELNNRWGGAIGPMIRVAGGSDDDDDLAGVLEHFASNPRETASAWRRSANGLRQKPGRQALGSYRLSE

SEQ ID NO: 1023961 - protein, 178 aa, Homo sapiens
AAGFRGGRRADPRRRLRDPPPPATASAESAPSPSAGLFRGRRLSRAWSSQTAAGVGAAGTIGPGGPTGAWTRGRRTGAPDSVWQHIPDPSAREPPQEKPRHGRGHELPPDPLEGLSTQHRHPFMGGPELQPLSTKSLAWEPMDWRPWVQAPGSYKQQQTTVRDWEMGHWPDDQSISGQ

SEQ ID NO: 1023962 - protein, 57 aa, Homo sapiens
ELGPTCLVSMLFSTSLVAVVVRSPAGSEKRLHILNTKRNSTICELTFPTDIRAVRMN

SEQ ID NO: 1023963 - protein, 102 aa, Homo sapiens
MPSPTMNNLKPKRFGPKDLNIFYPMTVKSFTELDFDIADVVFPQGGSSVHQRGLLEMRPERLRGTSLACLLVLGFKSLSRATRSHSVPGDDSSMSFTKSFFC

SEQ ID NO: 1023964 - protein, 219 aa, Homo sapiens
GRPGRPGCERLPHAPPPLRHECSPRGGKRLQLPWEDGRSGLLSVRRSLVKCSVFHPVRGPASRCGFFSLLWLQLSVRLGTWPGQSGDKGRRPRALARACAREPPLSTGKKTRPRGHTQAPGRKLVPIPRNALEELLGLRAPHAPVPEEEEGSGHHIYVRNQVDHFRFNRAALINVGYQESSNQQRTTYACTDRRPDSHLNEELDYGINLRLGPIQVASP

SEQ ID NO: 1023965 - protein, 221 aa, Homo sapiens
AWTPARAYSHYHGGARILSETASARLASPLVIKFEELRSRDGYDPQKPSDNFPVVWPGGEWHLRDITNYMTTAAFELLRHAAVNRERWLRRFYEIGKEAIRERKEGELFAFVVPPAPAGSDRARRTEVLLATLQRGGVEIERASSFVADGTRYPDGTAVIRMAQPYGSFAKALLERQTYPDLRDAAGQPIPPYDVTAHTLPLLMGVEVRPIFKPFQYTARK

SEQ ID NO: 1023966 - protein, 42 aa, Homo sapiens
YCALGTGNSKNDLTKEECLKKAYRKMALKYHPDKNKEPNAEE

SEQ ID NO: 1023967 - protein, 464 aa, Homo sapiens
MWRLVHWHHVGKSDNGPPDARAAWPYAYPGKIPKDVVVHPLRVELVGAKRPRCVPNPARFLQNCRAPGGFMMQRFVETNLFLEEIQIKEPAEKQKFFQELSKSLDAFPEDICRHKVLPQWERFEFGNAGAVVLTPLFKVGNVPETLRSIKQKIIPDGGQDVLHPAERAMRIRLLAEDGAVQSRYLEEPTVSTQIFPKFGHGFLENNPAIREQTVKSMLLLAPKLNEANLSVELMKHFARLQAKDELGAHPLHSTTVCLGKNRLLPHGLAARHRVLTSAFSRATRDPFAPSRVAGVLGFAATRSSTQMNDCAQKILAVLCGAHCRILRNPVREQAFKGHSGASVFQLESVSEDPNQLEEVEKDCPCSIQPWNGEEAAASWAGLGRDRGSPHVTFQGWIRIGSQTIVPQRKAKIPQKNQGVKSSCARPEPGVTDTPNNLKGAGTTDEESTDTARGEHGRKDKGESD

SEQ ID NO: 1023968 - protein, 190 aa, Homo sapiens
GDLEDPCGDGVSGKRQFEVGVMESLRVASVWLWLRRGAFQRQVIRLGMAEGTREASDRQAIHGNAQVTSVGCSVPMASPSRQEGRITYLKLRSLDLLHLNLSGGGGTCGKCRPLGPNPAFGGESKHSMGELSPQGARVSMGWGSIQPLQGQGRDGHGGIYPRLEVDNGIFKEEIGWALWLHACNPSTLGE

SEQ ID NO: 1023969 - protein, 72 aa, Homo sapiens
LAPLEAKNMRKSSSFAPSSSLRSRQPDRAARRLCWPRLAGLPIPLDPATTHSCCLVNFPPVSGAMSGMKSFY

SEQ ID NO: 1023970 - protein, 68 aa, Homo sapiens
ILVTVPNRNRPEVIRLANVMAEGQGRRYHIQDFTLAFKNSSRNWCSGLPLELGCSLGFSPALEFGFIF

SEQ ID NO: 1023971 - protein, 327 aa, Homo sapiens
RKTDGSGLMRVPLAAVTVRFVSGPRDPERGEADRAVSCLSPSCGRPGDTEPSVVPGDWIGARTSTSSSAPGPGSSQGPGPRPCMPAHGLVPAMRELCVQVEGPLDWTWLPCCTRGLLVGSSFYGRVLYVTGATTRATRTGVSSARQGEEYRESCAPETPEARVKLGEWTVTFNRGFQQEVFLGKDLGGFDEDAETRPEPEEAAWSVFVQRWIVEPLNGRSVPKDDAWLDHGRRRRALPGGHGTTARHNFRAVGPERGRSRVSQTSIRVNVLASTGHNEEGGCRAHSGSRRNQRGPRNPGKPGKNRRARGHKGNTPDLNPSHTQTTTY

SEQ ID NO: 1023972 - protein, 408 aa, Homo sapiens
MSGLLSGQKLSNGSGITECPRGLVGLAFIGEATLDKLPRFPAPALPLLNRVDPHPRSCVAACPHPAAVLGTQSPPWCPGIGLEPGPRLPPLPLALAPPRDLGRGPACRPMVWSLRMRELCVQVEGPLIGPGFRAALVVSWWAAPSDGRVLYVTGATTRATRTGVSSARQGEEYRESCAPETPEARVKLGEWTVTFNRGFQQEVFLGKDLGGFDEDAETRPEPEEAAWSVFVQRWIVEPLNGRSVPKDDAWLDHGRRRRALPGGHGTTARHNFRAVGPERGRSRVSQTSIRVNVLASTGHNEEGGCRAHSGSRRNQRGPRNPGKPGKNRRARGHKGNTPDLNPSHTQTTTYWYPKRKQPGNTRQGARKTRETRPRKHNTDCQEPTYLECTEHTDNKRICLHKQVQHDTT

SEQ ID NO: 1023973 - protein, 182 aa, Homo sapiens
MVQGAPTVCLCILSSQPPLRCLLFTHDESLLSDSGHPEDSGQSAPGWPQGLLKPVHGLITHLDHPSMSWLLSKAPDPSLWRKREASGVLFVKQRCGRQLLFQSCLCLYPGTMGRNAPSLLFPCVEEAHPASSLLPQVKGAPLPGFEFQRCHFLSAPPGKFLLFPTFKAMAPPSQGGVRYTVW

SEQ ID NO: 1023974 - protein, 294 aa, Homo sapiens
CLEDPAWFCRRPGGTNWRWAERGHAHYQREGIISNKDILATNGVIHYIDELLIPDSAKTLFELAAESDVSTAIDLFRQAGLGNHLSGSERLTLLARPEILYCQRWNPIRIDAAIQGICFSERTVIKDQLASKYLYHGSDPGKRLGWRKGNVRGFVYISNSLCIENSCIAGPRQEGEVRDPVARMDRVLTPPMGTVMDVLKGDNRFSMLVAAIQSAGLTETLNGKESTQSSLPQMKPSEPCTKRTEQLLGDAKELGQHPEIHIGDEILVSGGIGAPGAVKSLPGDKWKSVEKTCG

SEQ ID NO: 1023975 - protein, 39 aa, Homo sapiens
AAAYYYYCSEFKLLTMYGDMPDTLPDTGDHQTDKFKKEK

SEQ ID NO: 1023976 - protein, 105 aa, Homo sapiens [sequence omitted]

SEQ ID NO: 1023977 - protein, 135 aa, Homo sapiens
IARVAMAASGAVEPGPPGAAVAPSPARTRSCPLSPVPAHQAEDRGAETTEIESLCMNCYCNGMTRLLLTKIPFFQRNNSELLFPASTVAGTPTEINRSEGRIQDQGVRLHFDSVRALEDMNRDSGEDMNVDDTRI

SEQ ID NO: 1023978 - protein, 146 aa, Homo sapiens
LGPVFSRAPFLTLVWITCVGMWHLSPFALGICDPSIVLRPLCPHFPVHVGDDGSPFPFAQLPPGARGPSPQGVWIYSFIRPGPPMFACLCTSTPNVSALPPEALCRASLFWRGRGCGVTCTLGLVDTVNSSQVDFSGGEKKGHLRL

SEQ ID NO: 1023979 - protein, 367 aa, Homo sapiens; identical to SEQ ID NO: 776241

SEQ ID NO: 1023980 - protein, 367 aa, Homo sapiens; identical to SEQ ID NO: 776241

SEQ ID NO: 1023981 - protein, 485 aa, Homo sapiens
GGPSVLCRGLEPGAWCLLEWVRAVSGWRDFHELDAVGPCTDAVAAVTKPARNPNAPVASCSHRRCGQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 1023982 - protein, 480 aa, Homo sapiens
MSDGFESGPRCWSGPEPGPGRVEGAGLRAAVSRTERGLLSGHSHQPRNPKPRASCSHRRCGQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 1023983 - protein, 219 aa, Homo sapiens
MCTGCVLLLLWVIWNHEAPQDQKTRHSVCLDVWELSANLIGGSGGGSTPTPRGKHSLISVGGGFRCQPAEGWTPLWSPMTAWKLPEIVDACQERVLTWVLGKASGRLLVYMAGMTAASSCGPSAKPYCIMSLTGHTSPRLESVFASTLPRGAQSWPCILSRRSHPELVGAVKHAKKFFSTLYGDTEGNNRADWDFHPVRPKFVVSGFPGDKIKALGTSG

SEQ ID NO: 1023984 - protein, 274 aa, Homo sapiens
ADRPSSEAQLPENNSNLPLWVIIMPSDLAKKKAANTQKGGCRKLRQAAQKHGHEENGDVSRQQPQVRERSNDGQLARETTEVDLLTKELEDFEMKKAACFELCTVLSWPLTPTDTECPQSLNLLTSPFTGSMSSLKVITKLEFKLRPCVHGLTWLQMELDKSMLLSDSSGKREVPIPAHIDIYHLTREMPPSDTDTLALLTDGRSDTAAAPMLAETRQSGWLMRMRTVEKLMELYERLEDAGCRPRSQMEGSRILHGLGFTAWHARKRLNASVW

SEQ ID NO: 1023985 - protein, 163 aa, Homo sapiens
MEGRSGAIVALAPNYAIYMLGRALIGVVVGGFWSMSAATAIRMVPKRDVPRALAIVNGGNALATVVAAPMGAYLSTVIGWRGAFLCLVPVSLIALAWQWKTLPSMPAAARAPGIGQVFKVFTLFKHPGVVVGMLASSLLSMGQFGLFTYVRPFLETVTNVHGA

SEQ ID NO: 1023986 - protein, 45 aa, Homo sapiens
AAAYYYYYCSEFKLLTMYGDMACWAWLGAPTPGYLVGINRQIRKK

SEQ ID NO: 1023987 - protein, 63 aa, Homo sapiens
MGSCADIQLKWSLEQHYYIQVRAGDNKYMHLNVLKSLPGQNEDLWYLTGLPGLTKEKELTTRD

SEQ ID NO: 1023988 - protein, 245 aa, Homo sapiens
LQLQQVALQQQHATACSSMQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQDQPHNSAATDAAATASVLPGCCPSSCSKMHHTQHQQPPTQPQQPPVAQNQSSQLPQQSQTSLWCHRRKLSLDKCSIPNTTEICPSSDGGAAAPSEPQVQPARRQAVLNASRSWNCRLEQYSDHLVFNNFHW

SEQ ID NO: 1023989 - protein, 162 aa, Homo sapiens
SSGEHREGSTLQDRTSHADRSICPGPRPARTHTAPHTAPPHPATSPVDCLIHPPPRWPADLVPCSHPRAGGADAALWVPEGPGGSDDPPPPTVLNRPPTREKGAIKRLSSNGEPEGHSPARGAQASLGQPRFGPSREIRAPTSTSIADRKGRPSRQTSFFLG

SEQ ID NO: 1023990 - protein, 261 aa, Homo sapiens
KRALVSGAYIGPASPIPDTNPGRLPPSERGPHRAIEEPRQLQAYGTFKPRLATTSWDLGPVTACGALQAGLSLPTLQSCGPLPSGARPIERQGKNPTRDAGLDGRLFRGPPPYKAHWWCAHQSPCNAPFCAPTIAQRGAPGIDTPRRNSTKSQRLCDTMCVSSKKLEPVAQFPRWSTQSFLPNSRRDATGTTSYWTRSREAPKLCGGRCAHPKVVVWAPHKEIGRLPPGNLCGLGKHTGGYPRSARQGPRTVTMRHSPVGC

SEQ ID NO: 1023991 - protein, 476 aa, Homo sapiens
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTWMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNSYPIKLFYTSNIPIILQSALVSNLYVISQMLSVRFSGNFLVNLLGQWADVSGGGPARSYPVGGLCYYLSPPESMGAIFEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 1023992 - protein, 247 aa, Homo sapiens
MATYGAAAAAAAAGMAEARSQPSAGPQLNALPDHSPLLQPGLAALRRRAREAGVPLAPLPLTDSFLLRFLRARDFDLDLAWRLLKNYYKWRAECPEISADLHPRSIIGLLKAGYHGVLRSRIPLAAKFLFTEIAHWDPKVFTAYDVFRVSLITSELIVQEVETQREWNQGLLFDLEGGAVIIIAFQITPSVAKKIAAVLTDSFPLEQFVASIDNEPEIANASFHEQHPDENKTDPDGPHKKCNSKFL

SEQ ID NO: 1023993 - protein, 98 aa, Homo sapiens
MATWGAAPAAAAAGMAEARSQPSAGPQLNALPDHSPLLQPGLAALRRRAREAGVPLAPLPLTDSFLLRFLRARDFDLDLAWRLECNGVISAHRNLRLP

SEQ ID NO: 1023994 - protein, 47 aa, Homo sapiens
AAAYYYYYCSEFKLLTMYGDMTHLHCECLSSHNWDTMHFNKNISAVK

SEQ ID NO: 1023995 - protein, 45 aa, Homo sapiens
AAAYYYYCSIQASNDVRGHVCDTKKFITEIQDSQLLLKCSGFTKK

SEQ ID NO: 1023996 - protein, 189 aa, Homo sapiens
TRLPRVAASPLKSLLVSTRISCEVPGMSKDGLHQLTESSFLYTDGRVKGENENRSKLLFCWESEGGREAGSAHVMKRVALSGVSRAEGFGRSWALVVFKDYWSLGFEEPHRRESPGKVSMRGENTIVGWNTRGESMFLILYNVKVCSPLRGCHSKVDMTGEPPLHVEPLRKGGEEENGFRTWMRDLPKG

SEQ ID NO: 1023997 - protein, 189 aa, Homo sapiens; identical to SEQ ID NO: 1023996

SEQ ID NO: 1023998 - protein, 262 aa, Homo sapiens
MVNFTVDQIRAIMDKKANIRNMSVIAHVDHGKSTLTDSLVCKAGIIASARAGETRFTDTRKDEQERCITIKSTAISLFYELSENDLNFIKQGKDGGGFLINLIEIFPGHVQSSPGEVDWCLSVVTDGRIAAWMDLACQRVCVQTETVLRKAIARHQACVMMNKMDGPVELQLEPEELLPDFPAHRGERATSSSPTTARARGGPMGTHHDRSWCSVTGGFGSGLKGGGFTLKRDCEKLWASSRQGEGSGAAERPRIRQGDNRA

SEQ ID NO: 1023999 - protein, 128 aa, Homo sapiens
SCLVTVSVVLNPHGIKVIYNEVNNKSWMDRPVHLHITCLKSWMDRPVHLHVTCLKFWMDRPMHLHVTCLKFWMDRPVHLPVTCLKSWMDRPVHLHVTCLKFWMDRAMHLHVTCLLWRGVGCAMFLLWD

SEQ ID NO: 1024000 - protein, 258 aa, Homo sapiens
GSSARPRRTIGKWRGGPRDQRREKLGSYVLLATRLAFQASDHNALPSLPRRSLLDDDRSPLSPPRFLTSDEVGSDHLYVWALPRPYWVVVRGRPGCIPAPASLSPWVMLCCVLCRTVQPSPPCLCSMCLRPLSHLSSRSSVPVSSPTVLGDVSSGVWGPFSVSPGVSLSLPYCPFSLELISCPPLWLDAVPHALSSVPRTCLYASIWACFQAPRFVCSSLVNQTEWRLTDTNGRVQSDDLSRPRSELWGRIQEPRPFT

SEQ ID NO: 1024001 - protein, 404 aa, Homo sapiens
GKVLKRRKKDKDDKEDEKEKDAGNFDPESSWQASTMQQSRTQNSSSNNHGEQAANVNTGYGNNHQEQPAKTGNIDSSMHNHRAHTQWQFQQARMHACTHSMDPYQHSCNTGQGNMHHGRDEEFSIPFSMRLPMAQHSATAGTAQTQHLTTAAQCTDRCDGRHTCNTASLEPTTSHNKLSLGCDNTKKQLWTSDQEDKVADGELTKDAMEYSSEEEDSDLQTALTGYQTKNRRTASSKPVNHWHKTRVLSHIRNKLLMFERPSTLANKLSSQEREQQCDFDLAPGQGHYQVIAGNTVAPNAITEPGGITKVATSQERNGGAIPLTNEQGKINKAHKPNQTPKTETRKKGRTTNQKGTAKTKAKSKKTREDRTTPKRNKEKRKKKHNKRKKTQRKHNNHKSNTPQQ

SEQ ID NO: 1024002 - protein, 95 aa, Homo sapiens
MALLVTRTVLATRAVLVARTVLVARAVLVTRTVLVTRAVLVARIVLVTRAVLVTRIVLVARALLVTRAVLVTRAVLVTRALLVARALLVASTELV

SEQ ID NO: 1024003 - protein, 36 aa, Homo sapiens
RVYSPLRCLLPVQVRRHVSTCDLQISLAGAGRSRGP

SEQ ID NO: 1024004 - protein, 176 aa, Homo sapiens
TKTDLVSAEDLGRLEGVIATFNPQARIVRAARGAVALDDVLDTGLFDPVRAEGAAGWQKALMGQMLPETEEYGISHFVYRAAKPFHPEKLKACLNSKWPGVIRSKGFLCLATRHDRVGGWSQAGAVTQFGPQGRWWASAPRERWPYDPTWRAAIEKVWRPIHGDRRQEIVLIGQNM

SEQ ID NO: 1024005 - protein, 40 aa, Homo sapiens
GRLLLLLLEFKLLTMYGDMHLDLYFCQKIQGYNKTKNYQK

SEQ ID NO: 1024006 - protein, 415 aa, Homo sapiens
ERARFGELRQAAGTCVRPDEQDRLLWFVTSTARTAILIQQCKHLTLPADCLACPSLGCWSRAQPRMTDAYHPCLEQPRTARNSCYMPCNADPHLTSRTHATNLTSRCPCCYLPSAALRHSAHILAAPTPAPTAPCAQATLPLPTGTHAAPIPQPTGTNSTNSHQTLAAASHQLELPPPPHMALAANARRTPSADHPTTHKLAVGPRLRPRAPSPRSSQKTTPALKSTTIGPLDERIDTGADTRAHEPTATAPVCPCYPADTQHGHWRGDIHQGEHPPYQPQEPPRHTPDGHRPPTSEPRPEQSAHPRRATPATTAPPHGPPPPTIGGLHPNTRTHQPGTLRPTHSAPSPDKTALTPGNTKSKTPTSHEHPHGATIGTPESTRMDNNTKQHKEHQNALTPSTSKCQDETQWNAHTE

SEQ ID NO: 1024007 - protein, 334 aa, Homo sapiens
RAARRRRACADKVRGGHGRRRRRIPGRYFCHVLLRGGSSRACRSYICPRCEILGSHRGASGRDQEHRKLVLARALTSKDVPQQDQSRSPLEHVDQHLCNAAQGYGQCAFGIFDDSFEIPTFPPGAQADDGRYPESRRERDHPSLAPGTVPDSPASRLTTRRATEPVSTKCCPHAVEGIMPAARQRAVITPCHHPQPEAPGGVLHFKTLCDYAWGANGLDAIIYDSSSNQFDKLQAPHRQDHRTKIQALPTVPVTEEHVCSGLECPVCKDDYALGERVRQLPCNHLFHDGCIVPWLEQLDSCPVCRNKPHGTEHGTNPPGLTGVSFSSSSSSSSS

SEQ ID NO: 1024008 - protein, 126 aa, Homo sapiens
VVSWASDFGLGICCGLRFTYFLSSSVRIYYLLLRRCPADMTQLMKALDRVQMEDTQPRERRAVSIQMKPKVGQRRGRANVLGLDLGASTQTQPDLLGSAERCTWVPATWPGSKCGKGGEATQEETL

SEQ ID NO: 1024009 - protein, 307 aa, Homo sapiens
NEASGGAKGVGSGFLQTFPGIWRDHRCRVFGFHDLRSGYAATAAATATPTVPGSVHISSQAAVACSSSGSGSGSGGHVVRRRRWVSEGWFGRGGGNGCWLCGVQLAAVASGLYRARALLGTLPWYLLARPVPLDLALCSDAVGGPVRRQCPPSEETTKVVPPDRSNFPEPPRFPPPQAWAVLSLEILGTPLFFPKLILKSLTHASVPKPSSQVLLRYIFHAPSSEKHPPGSLSERRLIWKKSSVESSGTKKLGTSNKSRDSREKPGRELKDIIHHGNRMKISTIRKRRISITRSNESHPNGRAANQR

SEQ ID NO: 1024010 - protein, 275 aa, Homo sapiens
MWLSLQSRVSPPVSLLQQAELESDPERTLAMDSALSDPYNGVPRRAAPQSIRGASTREGIALATELLLMALLPIFFGALRSVRCARGRMLQIVPETITSRDAARFPIIASCTLLGLYLFFKYFSQEYITLLLSMYFFVLGILALSHTISPLHELVFPSQSFQYRQYQLLFTQGSGENKEELIIYDFDPKALCVSGPEQIVGVWYLLKKAVYLPNNFGAGFSLNGVELLPLNNVSTWLDLGGGLFSTMSSVFCPSVGDVAHSRSPKIGVSRSVGKA

SEQ ID NO: 1024011 - protein, 92 aa, Homo sapiens
QCTPVYLVLAVDNLFHEVETDQLLTFSLFGVGCCNVFNFGLGGSVEVKKLFKIFYRNICESKPDHIRQGVTYPQPALPVLLHVTASQSPGEP

SEQ ID NO: 1024012 - protein, 89 aa, Homo sapiens
QCTPVYLVLAVDNLFHEVETDQLLTFSLFGVGCCNVFNFGLGGSVEVKKLFKIFYRNICESKPDHIRQGEKLIRLHFQMEQIVYCQDQV

SEQ ID NO: 1024013 - protein, 41 aa, Homo sapiens
AAAYYYYCSEFKLLTMYGDMRNTKKLAFSLSVNKKYYTLEK

SEQ ID NO: 1024014 - protein, 35 aa, Homo sapiens
TPVRQRPDLGSAQKGLQVDLQSDGAAAEDIVASEQ

SEQ ID NO: 1024015 - protein, 46 aa, Homo sapiens
AAAYYYYYYSLEFKLLTMYGDMEAGPVRDLRLKKKKPIKKGSLMGK

SEQ ID NO: 1024016 - protein, 451 aa, Homo sapiens
MASLTVKAYLLGKEDAAREIRRFSFCCSPEPEAEAEAAAGPGPCERLLSRVAALFPALRPGGFQAHYRDEDGDLVAFFRCELTEIDIIGSMVHSCRRAGRSLPEIVPVEADDIEEEVAWAWTHPVHTVVSHVKSALENNGCTSQNCESCDRLAKWGLMGMETGIYVQSGLCLGLRLCGSGVPREQGVATGGGDTKKTSGIIPLVPFRVQTVSEGAFVGNTSVASPGKGELRGEHMSGVGQDWETMGSNEVKLEPTSSSCRGGPPWPHGRISFWSIGGSECEFPEERWGECGSLPLALWALKLISMWSTEVKRSRLSPVSPESSSTEEKSSSQPSSLLLLIPGSRVGNVEGATQSLAEQMRKIALGVRGAPLSDTTCELGINWFKEEIDDLDPSVFKSESGDPGLNSVKFQVPTRCRNPKVPQPPGTPPHEGPQGLDASCLVPISRNVNQAD

SEQ ID NO: 1024017 - protein, 414 aa, Homo sapiens
AESTESAHGRGVISSNGYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLSPVSPESSSSRGEEQLTAKQLAASDPSEAVVGNVEGATQSLAEQMRKIALGVRGAPLSDTTCELGINWFKEEIDDLDPSVFKSESGDPGLNSVKFQVPTRCRNPKVPQPPGTPPHEGPQGLDASCLVPISRNVNQAD

SEQ ID NO: 1024018 - protein, 414 aa, Homo sapiens
GFPSARPLAMASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLSPVSPESSSSRGEEQLTAKQLAASDPSEAGLGNVEGATQSLAEQMRKIALGVRGAPLSDTTCELGINWFKEEIDDLDPSVFKSESGDPGLNSVKFQVPTRCRNPKVPQPPGTPPHEGPQGLDASCLVPISRNVNQAD

SEQ ID NO: 1024019 - protein, 128 aa, Homo sapiens
QFNLRDDRGQPVPYFIRHAREIDPGLIDRQIVHYGNYDPFMEFDIQINQIVPSNGYRTLYIEANQPGNVIAAKSDAEGILENAFWQIALNEDGSLQLVDKDSGVRYDRVLQIEESSDDGDEYDYSPAK

SEQ ID NO: 1024020 - protein, 33 aa, Homo sapiens
ELDGLDPNRFNPKTFFILHDINSDGVLDEQEPE

SEQ ID NO: 1024021 - protein, 45 aa, Homo sapiens
AAAYYYYYCSIQASNDVRGHVSLLMIPLPPHLNLFNFLIKSDCLK

SEQ ID NO: 1024022 - protein, 348 aa, Homo sapiens
ASHEIWRSETLLQVLLKCGFITYILGGCIKKDAVPLMSKLEVLRHTRTSDVLQSPLYEPPANPDLLGPSYDLARSRVTPTEEHVLGGAPAAEAPDTPIANSLKPEQASPSEPHPHARQTPGGVQTGCCPEVRTSRNSTSSCSIAEDTGPWTHRTEAVQEMWLSYLKPWRYAPDKQASGKENPQTRECRQEKWAPYVQENTADVHQVDKWAYCTERSEQSMVRPKHALIGVRVGTVIGQTKPALDASKKVSKLYMEPEWIITNRQNEYKGPNIQWEQTCNHGNKEDDAPFKGQSKITRLERQRTAKTPRKVEQKHEHQHNTHKSRHAKQRQDITTIENTDDTSTRGVAK

SEQ ID NO: 1024023 - protein, 129 aa, Homo sapiens
MRVHRTIGSTRMDIKIAHARIENKIVNLLEPLATLAWTLGFEYHHGLLEKMWKEILKNHAHDSIGCCCSDKVHREIVARFELAEDMADNLIRFYMRKIADNMPQSDADKLVLFNLMPWPREEVINTTVR

SEQ ID NO: 1024024 - protein, 97 aa, Homo sapiens
LSGPKFLPVLPEETSHPNPSNDSPWTTYMLQSCQTVSFFEREDKNFQNEQNTINVNSRDGTLVFGWGENNPFEKKTTNEKTTKERHQEWIQQNHFTF

SEQ ID NO: 1024025 - protein, 74 aa, Homo sapiens
GGRARVGGGQASVHRLRREDKNFQNEQNTINVNSRDGTLVFGWGENNPFEKKTTNEKTTKERHQEWIQQNHFTF

SEQ ID NO: 1024026 - protein, 129 aa, Homo sapiens
MKCHPSCRPCSDLCNKEQSIKPSQGFEGVTYKMHNVKQCKSERCKIPIKELEADRCASDNSHLPTQEHSFQFSITEQQPEQLEGRAASQTSTNNGMRLDIWNHNHNRPERPTSLMTSFFFQRKVSVWGT

SEQ ID NO: 1024027 - protein, 124 aa, Homo sapiens
MKCHPSCRPCSDLCNKEQSIKPSQGFEGVTYKMHNVKQCKSERCKIPIKELEADRCASDNSHLPTQEHSFQFSITEQQPEQLEGRAASQTSTNNGMRLDIWNHNHNRPERPTSLMTSFFFQRKF

SEQ ID NO: 1024028 - protein, 100 aa, Homo sapiens
TGGSSSSGRKFVDRVSLIKGVWDSFKFFLLTRIVICRDVLARLVRLCFHDSLQCCQTIRDWLATKAHGDSVQARHHSLFNLVLKGFIFHPIQAEGNSLLN

SEQ ID NO: 1024029 - protein, 59 aa, Homo sapiens
LELCLSEGAQPEEILVSGATRRDKMADREKKKKESILDLSKYIDKTIHERIRSWIVDVG

SEQ ID NO: 1024030 - protein, 45 aa, Homo sapiens
AAAYYYYYTARIQASNDVRGHAVGKMMLIDLLTARLPQTFSLSKK

SEQ ID NO: 1024031 - protein, 115 aa, Homo sapiens
RAAGAERHGRASVWAWYDRDQQNMSNVITTQVHRFTVNSTLQASQIHGGGSIDLFLRGSKKLQLSAHKVETEMETSSPTSREPRKMTGEETQVSMGTGAHSGQGGGLSLHLLTLG

SEQ ID NO: 1024032 - protein, 96 aa, Homo sapiens
STGVSTCIGSEVPSEDKFLPRASHFLTVDRLTRRNCNRTRQNRADLDPFTGLKSLDRSNNNQLSRSPNLGHMPELQTLNLSGTHISLFPENWLNRP

SEQ ID NO: 1024033 - protein, 95 aa, Homo sapiens
MIARIDAEKVFRKSLKSIPLLKTLSEIKSGIETRHNLDKGLFQKLNSDGILKSQTPQAFPLKSETSQGQAIIQQCPGTTDPMREAQMRTYRENYN

SEQ ID NO: 1024034 - protein, 345 aa, Homo sapiens
LTPNRAPKKKMAISGVPVLGFFIIAVLMSAQESWAIKEEHVIIQAEFYLNPDQSGEFMFDFDGDEIFHVDMAKKETVWRLEEFGRFASFEAQGGMGQHSCGQSQPGNHDKALQAYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTEKRGVCPMPNYGPVGYHICLHFHHLREHFNRIDSIHLNHSPAPKHVRPYFYYIPLLVYLSSLQIPFYYFTFFISYFLLSYFFSPFIFLLSLFFSLYLFSSYSLRLPLLLSLFSDHQTLY

SEQ ID NO: 1024035 - protein, 260 aa, Homo sapiens
LTPNRAPKKKMAISGVPVLGFFIIAVLMSAQESWAIKEEHVIIQAEFYLNPDQSGEFMFDFDGDEIFHVDMAKKETVWRLEEFGRFASFEAQGGMGQHSCGQSQPGNHDKALQAYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTEKRGVCPGADLWVWWASLLGNIFIIQGVRQSDAA

SEQ ID NO: 1024036 - protein, 31 aa, Homo sapiens
AVPGVITRSSQRWLGFHFRCHDLRNSTSLTL

SEQ ID NO: 1024037 - protein, 190 aa, Homo sapiens
MTPLSPGRPSRGQHLDDETQFRRRSTERSPSFPGSPGSLLPLLLYSWQMTTGKAKRGPRTEEAVPRVCRGHKPQKFASLLPETGRTVEFSFKSTCCTSVCNNHEITPVTANDKIKLVKMKLPMNQTGLNTAKTSRGQSIVRGGETSAYQAGARCTQGFRDRVFVSQGGESAGPIRRDIHAKAGVPALTAE

SEQ ID NO: 1024038 - protein, 100 aa, Homo sapiens
KNGPVQGACSDVFGLPALQVSDVYQHVTGEMMGGHAIRILGWGVEAMAHPTGWLPTPGTLTGVTMASLGNYSEDSVSAVEIEITKWWLEFHAPISTGKKI

SEQ ID NO: 1024039 - protein, 77 aa, Homo sapiens
ARYRPGRVVVAAFRAGEAFAGAGEFTGEAALVALVDRRVGAVVRHPGVAVVPHVFQRLQVVLQVRVFAVADEAAAGQ

SEQ ID NO: 1024040 - protein, 68 aa, Homo sapiens
HLARQSREACECLVLSWVPVADCGRFLGKAGEKLGDPGESLKAGAEEVKEMGDGCSKVREFAADSRVW

SEQ ID NO: 1024041 - protein, 169 aa, Homo sapiens
MKRNNHEPGNTRLLQAQVRIGGKGTARSKRAPVVHRTADRADDRKRFFTCLLNVMFSGYNNISGYLTEVKYVVHNHMSYQQMIQFNDPKASGISGERTLSPLLAMLDKAADRYATQYLKPALVLDSLTSLRRLADALPKQSVDGKAPLATGEDDDDEVPDLVENFEASK

SEQ ID NO: 1024042 - protein, 194 aa, Homo sapiens
LKAMKMIRDNLPPRLKNLHKVSPSLKGFLDRLLVRDPAQRATAAELLKHPFLAKAVPPASIVPLMRQNRTDEAQRPSPQAKEPPRVTPDPTECQVGGQGITELLPAREMLRVAPPSLLGVDEHPYYLNSSFGSRGLLEDTHGTRGEQCDGSQGTPALWEQAHPPNVPLCLQRRARGPPITGSLQWGSAGGGEND

SEQ ID NO: 1024043 - protein, 96 aa, Homo sapiens
PRYVLRVRNNAFDHDNLKIGIDEAHALGKKFYVVVNIQPHNSKLKNFIRDLEPIVAMQPDALIMSDPGLIMMVREHFPEMQIHLSVQANAINWATA

SEQ ID NO: 1024044 - protein, 305 aa, Homo sapiens
TPQATGCDRGRWRCLTRGAREDRHRGRPLQLGARADQELVTALMCDLRSCQTAGGMMDLDYVCEWEKWSRRMQPSCSILVSPLVLRLVPAEDLYRRFTMDLRQASDQDLTRMIHILEHSESALWTCTRSPRETATEAIYLPGVRTRSGSRPPVRQMPDGQIKVLDAMADTVGLNSWESSSGQPSGGGSPFVALSWLHNGVKLALERGEVGRLQLRGESSPESSSHRGITLSGGKPMEGWIAVTGRGLVTVFPGLKSQWVKVDDRRPESLCRLLGRVDLDDMASSRGNIVVGQEEEARVAVRIKVC

SEQ ID NO: 1024045 - protein, 61 aa, Homo sapiens
LQQHLAQLIMFSVTLYSAPRMLCGVVLIMFSERFTLLPGCCVIAVLIMFSEHFILLPGCCA

SEQ ID NO: 1024046 - protein, 109 aa, Homo sapiens
KANINKQEHDIIKQKTQIPLARELIDTILKGNNIFKNCLKEIDLYKNLVKNMKYIPTEDVSGMSLEEEMQEVARRTNYVKCVWTKKLLYLSLVVSPPPPPLPHNLFAGV

SEQ ID NO: 1024047 - protein, 111 aa, Homo sapiens
KRVVIAISPGDSVLHNFLWRIIRKITVVDGGDERADSVLAGLKAAGDAQWVLVHDAARPCLHQDDLARLLALSETSRTGGDPRRTSARYYETCRTGKNAIAHTVDRNGLWH

SEQ ID NO: 1024048 - protein, 49 aa, Homo sapiens
DEASGPNTQLRSISMEPFALVYFKLYLSLCIRTKKISWIMRMTAPVGFM

SEQ ID NO: 1024049 - protein, 103 aa, Homo sapiens
GAGGGLVAREARRRQARRLMSSEPGECRGGMRRGLARGSGGLGFGLPPVPCEAGPRPAREQQQRRRLLARLSPPPQPEPGEAKAGLGVWRGGGPLPENGNSLH

SEQ ID NO: 1024050 - protein, 411 aa, Homo sapiens
RAIVDQAVSARVRSHRQEQVAAWSSVGHFAYWAGSVLTTTVTRFPGLDRPDLRLPVSLTMEEHASQILDVEPPSESGIHLQTYGNYFLKTKFCPPVQSQAMDDLMLSPDDIEQWFTEDPGPDEAPRMPDGCSPEVAPHEDSKLPNTWLDPCQQTHLLGPCNQFCPFTRKPTMGSIRDTSLGILALLGQTKSCDLARTSPCPQQDVIANCAMTCPVAASGFDSKNHRHCDPEYAAIGPSTMQFTGTCRRIGEALEPPAMQRWLRITDGSGPLTSGILYHEVARTILQVMHEYGTEQNNTYYEHTAGEVPHMKTQPEDRGTETGPPSTATQLTIACTTDTQYCRRTDTGGPLSSRTNYNGDTPGKATENDNRSSRKQIDAEAANPGPKARIPETGRHSSSHRENKDIRNTTAH

SEQ ID NO: 1024051 - protein, 85 aa, Homo sapiens
TREEGKNEQFTLLTMMISMDKEGDSTILFRNSKGIPLAEITFTLCEYQGKRTMFIGGLQAQNGKFHIRKSRMRRKPATGYFPNAS

SEQ ID NO: 1024052 - protein, 53 aa, Homo sapiens
GTRSDITLQLVYLLNPHIISDGPHNHGRLVSPARKLHLPDHPGKGQRRPVGFM

SEQ ID NO: 1024053 - protein, 173 aa, Homo sapiens
MGTDKQIPQSSLIEYLSNTTLLETGPKIDSTGECLTGGGIRDTFPGGRFDDVVHTQNHLCCFSCTQKNLSLHLKTFCYTQDSHISNGAFPHIQSSSGIAFPGGSPELGHQVCTVIACIVSYGGWQHSQCFSIRIHCHSFFAWCSIGKCMSQHLRKASIKCSRVLSLRKKSIMQ

SEQ ID NO: 1024054 - protein, 282 aa, Homo sapiens
PGPSSTAARPTDSDVSLDSEDSGAKSPGIRATISVPAGGMAAFGSSVAASPPRPPAPPSSRSSQSPPREGEMPEEGIIEPGGPKVSGLFGSPRDEVSAEESSGVGDGLGTKAESSALALIQLCVTLGKTLPCDERSAFRMLYKCVAYGTRRIHQTSKFRLSIKYDTAMQHTLSLSLSLSLSHKQHTQQTDKTTDEDELPWVNDSGGMAVVILGPPARACIRAKGGQNTQARPPTLGSEGPAKSPDKATLVYQTAHTRGNHAPTQVAEQRGPGAKTQTTKAHR

SEQ ID NO: 1024055 - protein, 330 aa, Homo sapiens
GLQQRLKGLPGLLSSSWARRLLCLLGLLLLLLWFWGVLAAAGWAVLGWCLHSGCPVSLLCDAWAACLSLSAVPVIAGHPAALAAVPCGELRVSVVPAVVLGCACALCGQTGASCALDSVLPDLAVGVTPWGSCGALPVAAVTLFALLCSCALLSCCWLKLEMAVLLLLGGGFLLPACVALHAEGPQCPGPSGLPGPVARPPSLALPLGSGRDCVLLQEDFLAHRGLTHVYLQRIQLNNPTELLWPRCRLVGATCLASPKAFSSTLEKVRDHQFLIYSGRARLRHLGWCLLVLVGARRLVKRSSGSKTALDKTGAVGWCTVVAHNPQVLKS

SEQ ID NO: 1024056 - protein, 142 aa, Homo sapiens
GQNVSPFNGDGNRCALVSTRQEVALPEHNAFTAGNIHRINNRLLPAVGTVILNDSRQHGRFFAEHNAVVISDAAASITWHYRQYAPFFNPFHLTNRDFLTANVSIRPVASTDFTPPVELEGRVMPRPTERHSTSIRQPCRPF

SEQ ID NO: 1024057 - protein, 37 aa, Homo sapiens
MVLQALDDLDAMVAKVQLPQVHQVRQTLDLGQPVGFR

SEQ ID NO: 1024058 - protein, 226 aa, Homo sapiens
MRGSTHAIAVGRIEAAGGRGIGGSPLSLRGARQRMRPAVGHSLRWPNFAAAAPVAPGEPARCAENPVLSWAGEMVCLGAVLHGVLLALDLPEPRTRDPGSFLECVVGGQCRSSATGGCPRKLRAPPGIAPRPSPPGARGSGALRGSPRSPAVIPKLGYTAGLLFLPSICRLLFHPTSFTFSFPLIHPEAPRKWAHADTFRHRFPESSRIISQLVLLPLGEKRAPEH

SEQ ID NO: 1024059 - protein, 111 aa, Homo sapiens
ASVASVPRGPLAQPDISQGWRHMKIWDFGVSVFEPPVGNWLQELRNAEIPKSYERQVWLELMCCDRDIDPSGNGRTVTDFSAQRGELPSIVKSLIGAARTKTICAQNDSRS

SEQ ID NO: 1024060 - protein, 34 aa, Homo sapiens
GVNTVNSLSLSLQCWDLTWSGDVLGLGGGRVGFM

SEQ ID NO: 1024061 - protein, 52 aa, Homo sapiens
MQTQSILHIWCNEYHRTGVTFGNFRYQRCISAPVNIAQQTLLTRFDGQRITI

SEQ ID NO: 1024062 - protein, 259 aa, Homo sapiens
PRLRLRSPKDEAAPGFRSAGRPKGTAPRAAHAARARSADTPGMLAPQRTLRPKPPGQPQAHPEHAACRPGKGLELALLAVLHVLGARYGPVDAKDCTHEHTNYQTIATPRARCQPPDNGVMPDVRITRIPADSRKRSNSGAHQMCAFLLLHFRSRRPLSASDLSDAALHIYPLRNLLNGQTSGTGCRQRDSRPTSGAGNGATAQAPMGAHVPRECIHGFQTWRDLTTPSAAWGPEWSPSIPNGAFLSLLPLNPCGAHSP

SEQ ID NO: 1024063 - protein, 80 aa, Homo sapiens
EDPDTVVYPSWNQVNSSRCMDSTSFTRDAIHNAASDPVHSLMLHGIHCIQSGSIGPSCMKSIAVTLDAFHTAEWTPVHSI

SEQ ID NO: 1024064 - protein, 53 aa, Homo sapiens
MRQLSVKCFSQKSTWYKGYCCCCCCCVLLLVKRSSKNRSPAGELKRAPDPEWF

SEQ ID NO: 1024065 - protein, 112 aa, Homo sapiens
VPERPGLAVSGNLNWHSRLLSVNVQFLAAPGASFSALRRARPPAARAIVVATAGASDRRRDSQNAPVFSLETFGTGFQIASIHEQGIGREITEQRRQWFAEEQWLPVLDPGR

SEQ ID NO: 1024066 - protein, 104 aa, Homo sapiens
MGRGLREPAEQMVLVVCRRCNQMTGPVTTAFPSDSPMSSGHRCPPIQLEDLQEEAAVPGLRKPSFSRVVYIEHPGVHHERTVGSKWEANHQSSTWGGYSANSYS

SEQ ID NO: 1024067 - protein, 284 aa, Homo sapiens
MRTFPEAAASAAAGSRGRWALIAAVSPRRARRRPDGPRSSGPGRTLVPLTGGGSPARREENEEKGRQAKFDFQAQSPKELTLQKGDIVYIHKEVDKNWLEGEHHVTAWAFFPWLIIGRRLLDRKIEIPVGTIKGPPDYQVLEYGRGCGPDTTVQGGTWTVELVLPQGKSTSGLIRKVNENWYEGRITGHRGGQGALFPCLATLQGCTPCSPGSGICDQRHHRSPKRMLPPDLTREPRAGPQTQENHTQQNPNPHERDGKDQSGENRHQKLESEAKQKRPTEEKD

SEQ ID NO: 1024068 - protein, 34 aa, Homo sapiens
MTYGQITLTGIRAHANHGVLASERELGQPFSVDV

SEQ ID NO: 1024069 - protein, 88 aa, Homo sapiens
EGNWLKNGQPGNCESLLPDTSLMEYATTPVPQSTVFWQQGHLGQWAIWTKGGVWGPGWQLWPKHENLVFLPPLLLFPQSCFSSNLLCF

SEQ ID NO: 1024070 - protein, 130 aa, Homo sapiens
MKHEEGYIVSVSRLLWCQKPSSGHCLILHRTDIYVCAVAECCRHMEICISRLADAVAGSEVEEAHMSVSQGRYTEGERQQRVSRSKGGPGSLEIRDENCKDFGLTTWRCWIDTTRTVSVERQWSWLQAIN

SEQ ID NO: 1024071 - protein, 272 aa, Homo sapiens
MSTEAVCEPLRTLAPVSAAVSAASCRTEPCTLEETPGGGDKLRSAANQPQPWVACSYWPSCSCALRGSPVSVAQCSFSFSQMFWKETAQEDRAFRVRHSLGDAPLQGVLGGRPRTIPLPTVHLPLLGTGEPRAVLGVSAGQSGLSLSRGPGGRGAWWLRGVPPSKGWNRGLHGSRSVRLACVPRVRLTDVSLALSEAGPQRTHGYLSLRGSRHGDRMTASDRCGGSRSTGVRLSSNEKGVCAGYAVSPFSWGAKKACCPRLRTTSGTRSKVL

SEQ ID NO: 1024072 - protein, 102 aa, Homo sapiens
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKG

SEQ ID NO: 1024073 - protein, 105 aa, Homo sapiens
MASKEMFEDTVEERVINEEYLQWPSLTVQWLPEVTKPEGKDYALHWLVLGTHTSDEQNHLVVARVHIPNDDAQFDASHCDKRQRVKLVALVLLEKLNVKLKSIPK

SEQ ID NO: 1024074 - protein, 97 aa, Homo sapiens
HPTGSSPRSSEIYPKRKEVVLTARDLINTDISKMFELEFKAMIIKILEGLKKHRKSLLVEIKELKSSQAEIKNAISEMQSQVEAHKNKDEQIRKVNQ

SEQ ID NO: 1024075 - protein, 108 aa, Homo sapiens
MGAGEVRVLGGTEAHEDGIPPEIHGPLQQMVIEPQSLYTWDIVCHEQIPKGKAYARCLKDTKPVNSVFCPLFPFHRDTLEAGYGSFMGVTGQTLVHWTDITTVEYYTD

SEQ ID NO: 1024076 - protein, 484 aa, Homo sapiens
MAAEGDQLSLPPQGTSDGPEDTPRESTEQGQDTEVKASDPHSMPELPRTAKQPRSPAPQVRKMDLSTTWPRSFPASLREQHERLHDRLMAFVRHAHAGSTAREGQSSCILRLGHQHTIHAPRPTASIPRELIQEFQGLTWPHLSRQLGGVMSIGHRPGLLLHPAARQEELEQFSSPSVKNEALLMILGKASAPAELCQFQAAVFHAFLSNNRKLYKKVVELAQDKGSYFGQPGAGLQGVQPGDDGRARPPARRCCQEIRTMMTQLKSYLLQSTELKALVDPDPALLKGGSSKAIVESALYKCVLKPLERKPIKLNCPVQFKEFQRRQGIGFRFARKLQGRNQVRDPWATTTIDLGVTTSVPEVPMMEKILQEVHQHAKAYSPEKKISILLKTCKLIYDSMALEPRKPYGADDFLPVLMYVLARSKLTEMLLNVEYMMELMDPALQLGEGSYYLTTTYGALEHIKSYDKITVNRQLSVEVQDPSR

SEQ ID NO: 1024077 - protein, 297 aa, Homo sapiens
AAAPAQPNPHGPEVAEGPGAGGDVVLEGLELVRAGRWTLAPAHGREPVAPGRARSPNTTTVASAAFLGLSVEHGTQNLVPIQSWCHLKPSFPEHEPQSKLTPSDTSTLQPYCTFRYLVTDRMDDVGAQCFKSRKSSLVTFHTQLSSDDERKKVLLDPYIATLDSGLGQVSRGFDSLVHHLLIHRPRTVVSKLRIMERLTGQARQTRSTTRSLQAMVAHDAEPTGLVGTWSPRSHQPESGCRDGAAPVPRPVLASSCSWRALRTSPEDARTSAALAPELLRCLVGRLPAPGSVRRCRT

SEQ ID NO: 1024078 - protein, 334 aa, Homo sapiens
GRPHLPNPTRTVRKSPRRPGAGGDVVLEGLELVRAGRWTLAPAHGREPVAPGRARSPNTTTVASAAFLGLSVEHGTQNLVPIQSWCHLNALLPRFLNSLVHHLLIHRPRTVVSKLRIMERLTGQARQTRSTTRSLQAMVAHDAEPTGLVGTWSPRSHQPESGCRDGALRPGPVPLLLACRLVPWERLFPSPSAPRDCTAPSAPLRRTPYKGPRLAALPAAGGRCARAVTRGLLARCPTQARVFPGRPMNGGGPREPGRAECLGEGLPFIQRCLQGLPEGSNAEHSLGLTLPLRRGKPGPHRLYLLGESCAWGGPGPWKIRGRSLLGRSRGPGEP

SEQ ID NO: 1024079 - protein, 50 aa, Homo sapiens
HEVKGGWCGQYRCAVVVEGVGWEDKVGGAGPSEPQARGRSQCEVQPFAKP

SEQ ID NO: 1024080 - protein, 50 aa, Homo sapiens
MTRNMTLSYGEVVLTCQACLSPGQVRLGDNYKATAAFNLFMVKRKNTTPS

SEQ ID NO: 1024081 - protein, 73 aa, Homo sapiens
RPVAFTIDPEIDAANNPHNGHKKRPEENEPHHQFTRVKVRYARGMHNTRHNIKNDTMRLIIFRIPRLLKTQDE

SEQ ID NO: 1024082 - protein, 58 aa, Homo sapiens
MGVCRVTIWYKRGLVTTMEVVQMEIEWFHGLAEEVWTFIYRSNKKCYMTKTTPKEILR

SEQ ID NO: 1024083 - protein, 58 aa, Homo sapiens
IWASVFKAPGHLIRFLMLTLHLHHKPTCQRSLSLEDCRLTPLLTLPRYWDLRCIDEAK

SEQ ID NO: 1024084 - protein, 103 aa, Homo sapiens
MAQSKSGWAEARESISPPKVLSCNGVESKFKDVGPHRTRFGAVGLSTGSWLGVNNRFLGPMELMGLPHSMAWRCERSQHWEPQSVSTGKLIPRNKSTLLWPRV

SEQ ID NO: 1024085 - protein, 56 aa, Homo sapiens
ELTTVMEMARYQYNKQQHCHQPRDTPVLPTQNHLPPYSESWARNEYGARKRVVGKK

SEQ ID NO: 1024086 - protein, 243 aa, Homo sapiens
RRAHPVLEALVGLGEAGLRKSGDCCTDSGTMNIFDRKINFDALSKHGSHITPSTQQHLKKVYASFGLWYVCGRAAGAYVHMGHSFHSGLDLLVWLGLPGLLMIWLDGKTYIDPETEQKRLGFLAGLCIPYQELCLGPALEFCIAVKPMDPSHHAFMGTVTESLICFITQMDIYAKGAGSYLLSAEVSWMSSPEAGCLSLPWGNVDFGSIWLFQAKLYVGLVVIVGFGLFDTQFIIAKGEHGDQ

SEQ ID NO: 1024087 - protein, 255 aa, Homo sapiens
MKEHACDVRGRTDDNVPRVHPARPSVQVLSGYDWTLVPMPVRCQRLPAKAMPDVNAAHERLQWCGLRLARRKHRGPVPCTCDNAELSKTLGKLWRLLNESDKRPFIEEAERLRMQHNERPPGLQVPAQCWRKNGDGLARADGWSAPCGGGLSKVGPAAIHGPLQELPILDHLAPSEKGSPNVRLGNPEAPLRPDAMGLTSRFKQPRRHDAAVVGNGRTRKRERAAPWARAGSLTIDFGTWSLGEIQPQGNVQNGD

SEQ ID NO: 1024088 - protein, 57 aa, Homo sapiens
NGNSGCWENLRTSASGPALVTKDSVADPHNLKICCPSEWGSRPEQQPPNPDGIQRGG

SEQ ID NO: 1024089 - protein, 81 aa, Homo sapiens
KIIEVISKAPFIQITGLGGSALVGRDLSFKLMKIGYRVACEATRTYNATVSQALKKGDVQIVISYSGSKKEIVLCAEAARK

SEQ ID NO: 1024090 - protein, 66 aa, Homo sapiens
WRDYSQGLTELSDAHVPRYKKEGADFAKWGCVLKIGERPPQPSHIMENANVLARYASIWQQNGIVP

SEQ ID NO: 1024091 - protein, 159 aa, Homo sapiens
MATSSMSKGCFVFKPNSKKRKISLPIEGTIFNKGKNEPEDSSFEFRKLISLMMGPPIVDLENWANVPRREFNYKPCVTQLLELEFLGAKSSIFWGFPKGNSPKSFGAGSPIINFPRFSTLGGASGASWGVEIGAPGSSLGVLDHFPRKGLKQERALFQK

SEQ ID NO: 1024092 - protein, 124 aa, Homo sapiens
MATSSMSKGCFVFKPNSKKRKISLPIEGTIFNKGKNEPEDSSFEFRKLISLIWQQMKSENERLQEEFNKNLFDNLIEFLQQIHIPGGIFPPKEKANFKADLGGQIKLREIPTAALVLGVNVTDH

SEQ ID NO: 1024093 - protein, 65 aa, Homo sapiens
TEDDLGSQLRNRSVVITGRASRAEATLQKHRASDVQSISDYEKFTKGMDDLGQQCGRTDRPKERG

SEQ ID NO: 1024094 - protein, 30 aa, Homo sapiens
MSGYLYAVHGHAWRVAAPGKSHPLRRQKDA

SEQ ID NO: 1024095 - protein, 56 aa, Homo sapiens
AELTQHIMLDQAKSARLHYSSQQHWILNPMMQGQRLNQQPNGYQSASLTTDARQAL

SEQ ID NO: 1024096 - protein, 109 aa, Homo sapiens
RVTALYDEENSSVRMPLLPSGTLSRCEQKAHWSTDLSGVNKRSLHSAPLQVTATIHINGKLQGVTSVQDGSPSREGASSFISCKAHSETDNANHLPDRPHMTYRHVFIF

SEQ ID NO: 1024097 - protein, 345 aa, Homo sapiens
MKSRPSGPPTLAASFAHLHRPPERNDSCEERTWQPIYRNHHRKAPRSCLPSPESIAGMSGDEVIGQTQKLTCSPPGTTSPKHYSRCLPFLKETFAISTVKGKGESPPGKKCDQGGGGRRPLGLPPVPPMCPAGPSSRFHSTWFRHRCGHFLTRPHNSHLLIHFLHWIKIMLGHGRLPSTVSNVRAWGYAGQGGYAPMSVEPVEKRGGPPGLKVCRFNWGLFSLGHKQASKGQVWHWSRMGWIPERSDQGPSEGLYNESLYVTGMAWKLPVKAPGPLHDEVTDEDSRQPTGTHEPNRGTAGKRHKSDNTREDRHEGQSTNRDSIGGRTEPHQRHQGDSDDERSLRD

SEQ ID NO: 1024098 - protein, 146 aa, Homo sapiens
KALLAHFYAVANWDIPDGFLCPPVPGRADYIHHLADLLAEASGTIPANASILDIGVGANCIYPLIGVHEYGWRFTGSETSSQALSSAQAIISSNPGLNRAIRLRRQKESGAIFTGIIHKTEQYDATLCNPPFHDSAAAHGQVVSVN

SEQ ID NO: 1024099 - protein, 175 aa, Homo sapiens
RGRAPPWGRSPRVPLAVAAADACGGGGFGVGVRWRQQAQGPLSLLWGWLWSERFWLPENVSWADLEPADGGYRGRHLSVFPLAAGIFVRLLFERIAKPCALRIGIEDSGPYVPNSNAILEKVFISTKYPDKKRLGLHQLDWNVRNTHTAGFAHSGRNFTDNAPQPPYLRLSETHC

SEQ ID NO: 1024100 - protein, 40 aa, Homo sapiens
ARPAEVEGIRESHDAISGERILVGPDTRREESCRPVAQRD

SEQ ID NO: 1024101 - protein, 336 aa, Homo sapiens
AIDPSAPSTVDSIAGEMKRTVTERPKVAQPPYPILFPCPYSLWRPTSPPRDILLPILVSALPATLFSFSDMLYKMDPHQIMESSPALVLYHHLDAKNSKKVLRRVCVYKRKCRDIRPDASLSDVLGLGLGQLLLTFLNSSSPGSPRPCAPINPGVAIHQDSLVDSYKHFLQVSCSCVQLCDNTILAVCQGPCLDHGSLASSSLGTIVCFQKSTVLDDQQKRAEDRPMPFTKKCADEQHLTLLVPMACSQISHAVSQQLLYQQKESSAIEGVTPGSLPCCALIGPWRFEQVRYSREVVSSCRAPGQGDSNHPPRFAQKIRKRDKRRGDPANTSSIKG

SEQ ID NO: 1024102 - protein, 42 aa, Homo sapiens
ESSRYPLTHAQVAVLSVMSEEQSCTERGSSEQKWLINLVLIW

SEQ ID NO: 1024103 - protein, 55 aa, Homo sapiens
MQVIQSEKTNPHTIRRMTRHRGTELRMRHATHSQTPAHNNKANRRENRTNNPRDH

SEQ ID NO: 1024104 - protein, 183 aa, Homo sapiens
MIFPYQFYGQIITKTGGNQGMLLALEGYPECQWYCDDAEYLKEVSPSGASWNQVIFTLGITRVDHIDAKRPLSNVTDLQVASFVDQNLLENSKITREKFFSKLKQLKKLHIKAHQADRVCGAHFPNLWQDLQSYSITKITKAGLFCKDWANLTFIPSSRDQIGLAKQDACFQLLLQGPEFHSN

SEQ ID NO: 1024105 - protein, 73 aa, Homo sapiens
RGSRTADEDPEPEGGAGLPEEEHEEEMNALRGQVGGDVNVEMDAAPGDAVGFHLLLVVLLQGKASSSLVPLSD

SEQ ID NO: 1024106 - protein, 67 aa, Homo sapiens
AHNRHSHKLQGNSRLSCTRVRNLGLLPCGHLPLLKSKSKGGGKGGFLLFKPCTLLWRVKSRACGERG

SEQ ID NO: 1024107 - protein, 49 aa, Homo sapiens
PHEGSLDLSSEMGTVSVGVPEGTAVLADCHSDFGRVATDLPRQDHPDAL

SEQ ID NO: 1024108 - protein, 103 aa, Homo sapiens
EFGTSSGCSWTEGTLGYGHRVTVTQMAQRGTAAAWPLLPKPAWSMQGAPEGGEVSHGAPSFIYGHGRPIWEPSYSFPFLFGPQMSLDAQRSFGGAFIWGSGSQ

SEQ ID NO: 1024109 - protein, 75 aa, Homo sapiens
RSCPPLPTKSVYWVLLHIASCALVQPMVQGPTCLSVSKQRFLKEELDFYFQQPGLTGLWYAVCELFRCAKLKAGP

SEQ ID NO: 1024110 - protein, 213 aa, Homo sapiens
MGLAGVCALRRSAGLYTRRCGAGGQVCVQRQHRLVHVESESVAVWLEVLQFQQSQLRAMAPIKVGDAIHRQCVGALNGEPGNKVNLAELMHKGKKGVLYESSCGALHALDVPRHNCQRYSGARLERSEGQGSTRWEAMSECNCCLLMTGRVGPSPQGRMATVRTPGLITTEGLSPQETDLELDDIAECPSIAELDVIKRFSMVEQGMALSEKP

SEQ ID NO: 1024111 - protein, 169 aa, Homo sapiens
MIGQATAADQEKNPEGDGLLEYSTFNFWRAPMCQHPLLRTGLALRAKTSLSHHLALMVFPSQAPSFPLLSHFKSVFSPLMCWLVLMNLPELRSMYSLIYLATPFLSKSLKSQRKWSSNGVLGHRDSSFPPKSYATSTWSPRALTLETILLIYTHHLSILSAVHNISYQL

SEQ ID NO: 1024112 - protein, 206 aa, Homo sapiens
MIGQATAADQEKNPEGDGLLEYSTFNFWRAPMCQHPLLRTGLALRAKTSLSHHLALMVFPSQAPSFPLLSHFKSVFSPLMCWLVLMNLPELRSMYSLIYLATPFLSKSLKSQRKWSSNGVLGHRDSSFPPNLIRNRAVGPGSCLVCTGHTGWRIKRQKSNFNLAGNTNLKGEPRMASHTVTEESLCPFQPGAAIHRNSLIVVVTYL

SEQ ID NO: 1024113 - protein, 41 aa, Homo sapiens
MGVGPGNPNVNTPGSLGFGHGAAGLLNALSFFTSSLYPSPP

SEQ ID NO: 1024114 - protein, 38 aa, Homo sapiens
MLFSLIQPTFGFQPRQADKHHRRIKNSTFTSTTGIFPA

SEQ ID NO: 1024115 - protein, 91 aa, Homo sapiens
SRGLRVDMLIWELGGWWPPSVPAYHRYACIPSLREKFPFLEAELGLLDLSWCNVMSSEFMEADRKEACSFMAWDLISDLSTHHHWIDCFAS

SEQ ID NO: 1024116 - protein, 46 aa, Homo sapiens
CVLVHIHKHLKCIKEQYGQQHVSFASPKAVFLLTLSPLLPYGPGPN

SEQ ID NO: 1024117 - protein, 155 aa, Homo sapiens
MEEEVVEASILVATGVVVGAGKRGNQSGTECDGGATIRSMRVVFIMSRNRKMDWVTKKPEIHLGNLDSCAEKRDPRILAKEMTKIEYRAWKTPYTTSKTSSSNILRWMLDQITDQTGGYGSLARGCLGRAGLPSALDIVGPDGLVYAVEFSHVLA

SEQ ID NO: 1024118 - protein, 59 aa, Homo sapiens
YASEALVVMAKAAVNIWVRLSCRHDFSAPGVETARSVTATLCFYVWKDLSWKVRRVIFL

SEQ ID NO: 1024119 - protein, 51 aa, Homo sapiens
MLRSVRCSPLVMLYTRRKVAYRRLPGLPATLRARHFHSRYRQRTAAMGNRY

SEQ ID NO: 1024120 - protein, 255 aa, Homo sapiens
MGHDYRGGVLTVKAGPGYRDRPPPSILCIAIHHGLAPLPLPTEVCLIYECRYICLASDIPQRAPELSSYLVCTGWGGSALSVSPLRCLLWHPLPAIAVDNNIPFPIAIENLDQSGLLRFAPGTEESYGASSPLSRHDLAYSVSPSSPWPVLSLELSVLRSFHGWESLTAASSLTEAGLALLLQVSFSHSCGCRNLIYREEPVAAGAPATAALTVLTTHLGQPFLAGALVASSFSIPFTVAKGWGEGMESNAADHG

SEQ ID NO: 1024121 - protein, 44 aa, Homo sapiens
MNTKKKQNTTTKITNTKHHHPHQNTARPSDKPNRHTASVPTQPA

SEQ ID NO: 1024122 - protein, 186 aa, Homo sapiens
RWLPPPAHFSDVVLSLFSLLCRLSAPLFLCTFSPSLGFALSVESLPLSSYSSFGFLLSSSFVFYLLSALCSSVLSSACDYLFVRSPPYSASPLVGVREPLYGLISRAFPPKGSSIWPNARVSGPSNISPLGVVGATSGHALLVDVSQTTRAPVSLRFGRVPRVCSWKCPRPLGLQFNWAIHRTSYF

SEQ ID NO: 1024123 - protein, 128 aa, Homo sapiens
LELVDLAGGTNLLDLMKLEIETPTHLIDVNGLGLDKIEVTDAGGLRIGALVRNTDLAAHERVRRDYAVLSRALLAGASGQLRNQATTAVICSSARAAPIFTTPISPAISASPGAAALEGLASARGGRR

SEQ ID NO: 1024124 - protein, 60 aa, Homo sapiens
VLPVLCQYTNTHWYWGETCEFNIAKSLVYGIVGAVMAVLLLALIILIILFSLSQRNRRIR

SEQ ID NO: 1024125 - protein, 111 aa, Homo sapiens
TVDDESVLQGRQDVGVQDARAGSELEPAAPGEIRRCSAARMACELGAGSVPECSVCAGIVCVVTMRDGVAAALVAHLVPGTEPPLPTARVLTGCSLVVHAPVPWPLPCAVP

SEQ ID NO: 1024126 - protein, 154 aa, Homo sapiens
MSEAGEATTTSKTKPPAGSDGGGRRVSTRTPAPKKPRVGKAGAPPRARGPLGDRPSNGRKGKTHEVGDQRAPGYARGAPHGPAHDVHVCSPWPGPAAQRATETAGEHITYGSLRGNTKLSSLVRTQWLKSGGFNAVPEKLGKYWGRLYYEFRKE

SEQ ID NO: 1024127 - protein, 234 aa, Homo sapiens
SGLLLRTSLALPHHWHQAPRHPLWLQENGYFITLLWMGLALLGGVLGRPAEQHRMAQVSVQPNFHQDKFLGRWFMLRALASNIEAGSTEKEGGVVHVQVCAWPLPRHGGLNLTSDLPLGKEPCVRPRTMLLQPAGSLGSYKLTGVPTGGSTYYRSQWWKTDYEPGTRCCTSQGSKVRLDEDFRMATLYSRTQTPRAELVGGKFTAFCKGPGTGTERYQWSFPAPEPMKVHDRNK

SEQ ID NO: 1024128 - protein, 31 aa, Homo sapiens
MPAGKQRQGFYWRYCCNRRCFQRSFDRFWFN

SEQ ID NO: 1024129 - protein, 87 aa, Homo sapiens
MDLLIVILSTSMTRCDHCGASCMVSSSSTLWWSLRALQTAASTFSVTYVAALQVMVPIMEGSHGSTDGHDCHSCWQTSADWAKRAEI

SEQ ID NO: 1024130 - protein, 150 aa, Homo sapiens
MARTKQTARKSTGGKAPRKQLATKAARKSAPSTGGVKKPQSANKGPGEPVDSIDAAFRSVNQGKVQNLELGSIPGESLAPFQERFRGGRGKNPGTKEKFSKKNPRNLGKRLSRVGRPSPKSQEIEPDLATERKGIKARHNRRRNNPIVGQ

SEQ ID NO: 1024131 - protein, 115 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAHPR

SEQ ID NO: 1024132 - protein, 154 aa, Homo sapiens
EPHRYRKVGGEQWPGVALCGSAHSSPARYRPGTVALREIRRYQKSTELLIRKLPFQRLVREDRAGFQNRPEVSERSHRCAAGKTKAWAGGGLGGFRSPSGINSAALVLNRRLAKRTWWVCSKIPTCVPIHAKRVTIMPKRHPVGSPDTGERELK

SEQ ID NO: 1024133 - protein, 86 aa, Homo sapiens
MARTKQTARKSTGGKAPRKQLLHGRQGALSTAGAKNPHRYRPGTVALREIRRYQKSTELLIRKLPLSLLPPRPATTSTHPPSHAPP

SEQ ID NO: 1024134 - protein, 115 aa, Homo sapiens; identical to SEQ ID NO: 1024131

SEQ ID NO: 1024135 - protein, 282 aa, Homo sapiens
ASSGRREEGSQAEPRPYRRGAAMWPPELRTRHVIPEACRQASQYRVPSGSPELRALDDGAGLSIVLSQRPALLPETRDRDTSVHHLYSAIVASSAICHFTHRSLMHGGIHGMTLDTTIHLRDYAMTTIEMTQMRKRTYDAEAQLDLVRFTLQALVYQPVERRALPNPNTYVAISPHEFKQGRPSTDRQNEVHTLKHIGGAYTHQNAPGDATTTRIKTGGLPTLQTRHPHVARGNRTQSSSTLTEHTSRHVLIQARNEKRRQTNSPISKTPHRTGTHTIAQRE

SEQ ID NO: 1024136 - protein, 567 aa, Homo sapiens
KHDDNKKQNLHAAVKDSLEECEVQTNLKIWREPLNIELKEDILSYMEKLWLKKHRRTPQEQLFKMLSDTFPHPHETTGDAQCSQNENDEDSDGEETKVQHTALLLPVETLNIERPEPSLKIVELDDTYEEEFEEAENIVPYKVKLADADSQRSCAFHDCQKNSFPYENGIHQHHVFDKGKRDFLNLCLRNSSTYYKDNSKGETSNTDFDNIVDPDVYSSDIEKIEESTSFERNLKEKNIGLESNQKSDDSCVSLESKDTLLGRDLEKAPIEEKLSQDIKESLELSNLYKRPSFEESKTTKSSLLLQEIACRSKPITKQYQGLERFFIFDTNERLNLLPSHRLECNNSSTRITLAEDREWIPDHSLSEYADNAIVLGVLQGAQSPSSSRKQQKMGQKSQRPSTANFPLSNSVKESSSCLSSSHPRSRSAAAQSSSRAASEISEIEYIDITDQNELSLDDTTDQHTLDNLEKELQVLRSLADTSEKLYSLTSEEFPDFSSQSLNISQISTDFLKTSHVRGPCGVEELSCSGRDTKIQSLLSLSESSTDEEEEDFLNKQHVITLPWSKST

SEQ ID NO: 1024137 - protein, 567 aa, Homo sapiens; identical to SEQ ID NO: 1024136

SEQ ID NO: 1024138 - protein, 100 aa, Homo sapiens
HIGLYCLCVLLVCGVLYRWVSVCARPCLPPLLTYRHVPPPRFYLIGRIQALPESPGPIVKKPPSFISNLIQKPTAQSYSDRLRKFQKLNILILLTRMSFP

SEQ ID NO: 1024139 - protein, 223 aa, Homo sapiens
YWGAHKIPQSHSIWNATGNRWCSWSLSQARLLTSFLPAQLLRLYQLMLFTLPGTTLFLSYGDEIWAWMQLSLPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPARASLPAKADLLLSTQPGREEGSPFELERLKLEPHEGVVVRFPYAA

SEQ ID NO: 1024140 - protein, 147 aa, Homo sapiens
MEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPARASLPAKADLLLSTQPGREEGSPFELERLKLEPHEGVVVRFPYAA

SEQ ID NO: 1024141 - protein, 223 aa, Homo sapiens; identical to SEQ ID NO: 1024139

SEQ ID NO: 1024142 - protein, 199 aa, Homo sapiens
YWGAHKIPQSHTYLKCHWQSLVQLEFVSGKAPDFLLAGSTSPTLPADALHPARDQGPLFSRLTGTEIGLDWQRALSVEQGQSEDPGSLLSLFRRLSDQRSKERSLLHGDFHAFSAGPGLFSYIRHWDQNERFLVVLNFGDVGLSAGLQASDLPARASLPAKADLLLSTQPGREEGSPFELERLKLEPHEGVVVRFPYAA

SEQ ID NO: 1024143 - protein, 149 aa, Homo sapiens
MPLAIASPIVQLAFFNRATPQGHAVAITYSPGGAGAGRTREESVGDHAKEPPGDGAGDGQSAAHRLDTLWLQPRHGITELGTAAQLGCHGSGLNPSGSLREAGGAARGAATQAVQLPARSSADPSPGGSCALRFAAPVCEVSSYNKCEQ

SEQ ID NO: 1024144 - protein, 189 aa, Homo sapiens
ERPGSPHPSLVPGVVVGSQESGVGKVKGARLEKWGLGWRNRHLSGVKRQRRGYWAEFFRAESGPSGSQLTRGGAGAGRTREESVGDHAKEPPGDGAGDGQSAAHRLDTLWLQPRHGITELGTAAQLGCHGSGLNPSGSLREAGGAARGAATQAVQLPARSSADPSPGGSCALRFAAPVCEVSSYNKCEQ

SEQ ID NO: 1024145 - protein, 84 aa, Homo sapiens
LSTLRISCGPLGVGLLPEADPSFGAAGSDGSVSRNVFQAPSGRAQRRSEGMMGISGILVVPWGGQGHPVSKWRQGLGAIGLQQS

SEQ ID NO: 1024146 - protein, 77 aa, Homo sapiens
LEIPLLPPRCVLGSVNSLCWGGWGLSRSHYQGRYLTRAPAPSTSESLSPAYQQPVQPPYGDTKHSATSCFISTWKAL

SEQ ID NO: 1024147 - protein, 123 aa, Homo sapiens
MPSRDALVRIWQEVALAREDASPCLRLGAFEIRRYQSQLWWIKSVTGQSENIVPWQTWLQPLELPAGLGSDSLMRGGGIRPPRADEAVSVRFKAPGLLHIFGRNGGRKLKKSGKSWACRGYVT

SEQ ID NO: 1024148 - protein, 106 aa, Homo sapiens
IIDCFHVIFKEEEKGWLTTLDSRVDTFWYYAKGGRWVLPIPVSEIPVEASSEPERNGQVVLQHLVGFNTDSQLRKSVLNGLVATEVLMWFYVGEIIGKRGIIGYDV

SEQ ID NO: 1024149 - protein, 122 aa, Homo sapiens
RIGADGLSIARTMGHVVRNLVEKTRGAGERGCELVKPRMGHTYGVIYAKVELVLPIPVSEIPVEAIQRPEKNGQVVLQHLVGFNTDSQLRKSVLNGLVATEVLMWFYVGEIIGKRGIIGYDV

SEQ ID NO: 1024150 - protein, 101 aa, Homo sapiens
RLTSSSSSSSSLLFPTFLHSLPSPPLLPPPRPAQVAASLGNCSPFRSRGSCPVPGRERAHRGPQDTRCESRGRCAWEEGGGRRRGHRGAGYNGATGKRNGS

SEQ ID NO: 1024151 - protein, 339 aa, Homo sapiens
RLTSSSSSSSSLLFPTFLHSLPSPPLLPPPRPAQVAASLGNCSPFRSRGSCPVPGRERAHRGPQDTRCESRGRCAWEEGGGRRRGHRGAGYNGAKDPAAQSLMIMNKMKNYKRRFSLSVPRTETIEESLAEFTEQYNQPPQHGGMRTCSLGPSGRDPTEECSTYLPQQTSGEEPGQLLTLDVQFQLAGRTRSRFSMEREGHLELLTPGRWDRMHAQGVCTGRAACLNSQTLTAQQEALSCTWISACPKEFLTEATDGEPQIWPKAGSDRMSRPELPVQTFGFGKLETYVKLGQKGKRGTHNATGVQREQKTGRRTKYGPEKRSGLKHEEEAPSNGTPKG

SEQ ID NO: 1024152 - protein, 235 aa, Homo sapiens
MNKMKNYKRRFSLSVPRTETIEESLAEFTEQYNQPPQHGGMRTCSLGPSGRDPTEECSTYLPQQTSGEEPGQLLTLDVQFQLAGRTRSRFSMEREGHLELLTPGRWDRMHAQGVCTGRAACLNSQTLTAQQEALSCTWISACPKEFLTEATDGEPQIWPKAGSDRMSRPELPVQTFGFGKLETYVKLGQKGKRGTHNATGVQREQKTGLENQVGPEKRSGLKHEEEAPSNGTPKG

SEQ ID NO: 1024153 - protein, 322 aa, Homo sapiens
GVSCGSFLGFFPSPPVFFRHPGPCVAHLDPLARGRRAFEGVGWRVWGGECGLRQEEFILRLNVAGLWHSPDVAQAVAAAWARVFLLSPAALAVGWAGLACQQRRLLYSFGWETHRCVRAVEVARGSGDKTEKLSWWSMRWPVWILTPDTCAEMRLCCAAPCRVIAPVQWCLHQSKECPWGGVYTGEAVMALCRDHKIGYNWAQRWGAPPLWAPREKISDEVESSPPVLAISSPGCDVASTAGPQPEGAHNSLVSSRQNGPQWTEQPPEAFPSPTKSCFPKGTRMAPDDRDTKIAIWEQEPCVNLTQESAVPCGRAHHKEGCP

SEQ ID NO: 1024154 - protein, 32 aa, Homo sapiens
MIALLAPLNGCMYLYTLTCNSIVPFYLLLGVR

SEQ ID NO: 1024155 - protein, 134 aa, Homo sapiens
PHCAEGRHRLLRHSPSAPEVGATLALPVMGTKTIASENGQADADECYDKGDDEQKRFLRGLQPPSGKLPAPDAARYYLPSVAVMAAWVTMTPGSGADPWFSVTLVHVVSVLTTPSFYSLVDSDILALLPLEEAA

SEQ ID NO: 1024156 - protein, 201 aa, Homo sapiens
PHCAEGRHRLLRHSPSAPEVGATLALPVMGTKTIASENGQADADECYDKGDDEQKRFLSVDCRTTAVTIHARPRAASAHTRTRYAVTGLPRFTLSVRLGGLSWVIRVYPQVRVSLRCLSTPVLFLVLSDSVSYCAFFPIERTAEPMSDEYFRKLPYNTDSTAGFARRGTKTVGTRGRRSLFRFLQSRCIRNTSSRNIFHSR

SEQ ID NO: 1024157 - protein, 42 aa, Homo sapiens
GPLRGTGGRRPSRQTRGYMEGNNTHQGLSGGQGVGDHQDKHV

SEQ ID NO: 1024158 - protein, 174 aa, Homo sapiens
MDEDPNGVDLVAMDLGVYQLRHFSISFWSSLLGTENASVRLDNSSSGASVVAIDNKIEQAMDLVKSHLDVMRSREEVEVLKEQIKELIEKNSQLEQENNLLKTLASPEQLAQFQAQTADWSPTPWQQPDQRARTESPRTRAASQGLRTKRIAAYDPRTEPGCMQCELNRRQKMC

SEQ ID NO: 1024159 - protein, 131 aa, Homo sapiens
FFLPPKRKLVSNFQPKNLCQCSPMTLRGHVWKLVPRDYAQVCLVLLSCLPFTGSCTMQLQFPAVIRVLQAVGKGAKVLEDSLPALEASSAVCVCVCRQALVLSPRLECSGAIMVQCSFDLLGSSDPPTPAS

SEQ ID NO: 1024160 - protein, 155 aa, Homo sapiens
MHGSSSKGTCTSRFFFMPRLLCVTDGFAIEQLLTSYLTVVRHYGASHKRFCGQRPIISSRYVALGADVSSLGDKQSRDFIVESLHTRLRCHGLSSDTLHDTTRTYGPVCQVASLGHSRVQCHFRRSQPDTGQSPLPTCTQETPVSYEVALVGASP

SEQ ID NO: 1024161 - protein, 111 aa, Homo sapiens
EVRWLFAVAARPACAGDLRRWTPAEPPALALAAAGSAAGWQHGVAPCGLLGLGWLAVACVLGCWAALKLAIYSADPGLGRAEEQNAEDSGYALSKSAEDLTDGSYDDCSKC

SEQ ID NO: 1024162 - protein, 37 aa, Homo sapiens
MRNVTGTEDAPGTEERHWAEDNSCVVRCFESFEWLSS

SEQ ID NO: 1024163 - protein, 215 aa, Homo sapiens
DVPSRGLDVEDVKFVINYDYPNSSEDYIHQIGRTAHSTKTGTAYTFFTPNNIKQVSDIISVLSEANQAINPKLLQLVEDRGSGRSRGRGGMKEDRRRYSAGKRGGFNPFRDRENYDRGNSSLLKRDSGAKTQNGVHSAANYTNGSFGSNFEPAGIQTSFRTGKPTGTYQNGYDSTQQYGSNVPNMHNGMNQQAYAYPATAAPPMNGYPMPTGYSQ

SEQ ID NO: 1024164 - protein, 76 aa, Homo sapiens
HLNPSAKLLAQMKDIRTGKSEYSKYARNWKEAWMADILRGWCYRKRMDIEMAVEMKPKNMIRKLSTDFPQEKIPRN

SEQ ID NO: 1024165 - protein, 214 aa, Homo sapiens
MGPELDSDEDDDELGRETKDLDEMDDDDDDDDVGDHDDDHPGMEVVLHEDKKYYTKQAEEVYGPEVETHRFTEEDTSDLLTENPCITAQLKTNEHSTLMETDITYTVYETGIPCAGIRTRITHRRPQQKTADPIRQTPSSSQWQRTHEPPQGIGRHTKQTHPRENTGKAAHRPPRNPGAHHPPPPPSQQQSHSKQSAVKAHHKATNPAEQPDPA

SEQ ID NO: 1024166 - protein, 39 aa, Homo sapiens
MATTAAFSWSPIPPWLLGSAFVCCGHAQAHELGGERIRR

SEQ ID NO: 1024167 - protein, 338 aa, Homo sapiens
TGRRRQGSVDETVGGERSRFPGERRGPRQERGLRWAFTSPPVGGETAPYPRGRGDEGAMPSHFEAEAWRGFREQVLELLCQAGRLDQTPGRGRRRGPPAKDSPQPLCLRLLRLLCADRVLCCVGNAALCSGRGFLSPPPRLATADAGRQDSALGVTRAGSLPLVKGPRHPPHIVTSSPPVYFIRGPRYVYISHDHSTKPFWANPLSPVSEIPSLRAGTPRSVLIPVSPGESWRRGVWKALSKTFVEAKKRRNRVMSRDAVKDRLLGRAQGNTGGRSGSGWQDPEGRGGCRDALGARGASRPQQGRDKRLLVRGTDVRLRAQDYLSHNSCPKRSFSGGG

SEQ ID NO: 1024168 - protein, 145 aa, Homo sapiens
MRDVHLSSTVGQDWCPDLAMPAESIYCLRTRHPQPPRNLGQNMAKFRPHKQRGVGKDQIKKGNTPKAFIQHAQDRGGKHRRGNAGKLFGGISVSHPICMFPKKRPKTVLCIISPFFCTKQRLLDNMEKPHGTGGTDGPHFRGGAP

SEQ ID NO: 1024169 - protein, 129 aa, Homo sapiens
RDSPRFLASIGLHVSPRFVAYELTVLVFLTLSVGGDEVSPGGAGPVSHSAEEQPVHQVDRLCGACPGQRVFLCPGEPGAKSGRHLSGGVPPYTECDHAQPLARPGAVESCNHEVCAQTGETVQPLMARR

SEQ ID NO: 1024170 - protein, 79 aa, Homo sapiens
PIASQTPQSQSPAFEPFNLLFSSRYLCIDRLLVFEIAEFEIAVFEIAVFEIAVFVIAVFEIAVFEIAVFVIAVFEIAVF

SEQ ID NO: 1024171 - protein, 222 aa, Homo sapiens
MRGGTSRGAFLLAEHLPEDQTQRDENIDGNYGFRYDLEIDGIGGGNPLTSKVAIISRFQQIRVLMSIICLRRYRYMSNVSIPTPNCGNMLSGVGAFAIENGLIAATSPVTRVRIRNVNTGTFIEADVQTPNGVVEYEGSARIDGVPGTAAPVALTFLNAAGTKTGKVFPTDNQIDYFDDVPVTCIDMAMPVVIIPAEYLGKTGYELPAELDADKALLARIES

SEQ ID NO: 1024172 - protein, 48 aa, Homo sapiens
ERGPGTSPVASDLTGNVGAVLKALCLITIESQKQLLGSVKNSTETSKD

SEQ ID NO: 1024173 - protein, 133 aa, Homo sapiens
MLQVPDPDYCSQQRISGLRTQTEAFQGWERTMLRYPSVYYEGFALSRAPGPEGLNTSYQSQLIKPSRMAGKVPKTGPGKDAPPRKPLRLAKVESCDRRFSRSDELTRHIRIHTGQKPFQCRIPVPRAGDGYRA

SEQ ID NO: 1024174 - protein, 88 aa, Homo sapiens
YNIKNGLPSETYITCAEANEMAKTDSAQVAEIVAVMGNASVASRDLKIEQSPELSAKVVEKLNQVCAKDPQMLLITAIDDTMRAIGKK

SEQ ID NO: 1024175 - protein, 326 aa, Homo sapiens
EKSISVGTMRAIITTSLVYFSSVVLFGACIELSVVLRDKYGDGVSRNLVVRHTGLAFTLGHLYIELLLFNVLALEPPEPHRGTTPICSAIAKDNIIHHSYRECFGHGKVNGEPTWALLLTALIAELGHSFNRHYPRKWVDPIYIHVLILMMLPVREPRPDAVHDTSMRTPNCARAPVQVLSLGAGPFLGMSHLTGPICKSPPGTMPWWTCIIDRHDLQITSSTKGLRNGVGVTGIRRQTHETQTQQSAGTQEWRHGAQLHTKENGQAQASHERVATMDRPRTTGTIHTQTATPAESRHTEDSPTDSKDLRQRSPTQQAGYTAIPKG

SEQ ID NO: 1024176 - protein, 97 aa, Homo sapiens
KLCQHETVATSGGVLSIDSHTSVGSSTHTVSLSRYPHRPPPSTHRLTNTPTLFHTYFPTATRSVPHTALLVHTHSHSHLYPSALFSAETYVHVQIDT

SEQ ID NO: 1024177 - protein, 53 aa, Homo sapiens
MASTDLGEKPERAAFPEQTRIGAELGFPEESSTFLRKQLARSSDFGAIFLNMA

SEQ ID NO: 1024178 - protein, 255 aa, Homo sapiens
MQCALYDAGRCRSCQWIMQPIPEQLSAKTADLKNLLADFPVEEWCAPVSGPEQGFRNKAKMVVSGSVEKPLLGMLHRDGTPEDLCDCPLYPASFAPVFAALKPFIARAGLTPYNVALSGELKYILLTESQSDGGMMLRFVLRSDTKLAQLRKALPWLHEQLPQLKVITVNIQPVHMAIMEGETEIYLTEQQALAEVLMTYRCGSVRKVSSRLIRRSPASCTPPRATWVRQLPVKHMWDLFCGVGGPDQFAYSESI

SEQ ID NO: 1024179 - protein, 230 aa, Homo sapiens
MAVGKNKRLTKGGKRGPKKKVGWIHFLKNDWVYDVKAPAMFNITNIMGKDPRPPGPTGPKMASDASQGSSSSDSDVWLICRMDRHVRLFQNIFKLITGKIVQGSTTLAWTNLPMGHGILTRDQTWLSHGSTTMGSTSRLRTLHVSIVKRLPDGFTWLSSGPGSGVLTKNTHQSESRRNLFMSPATNRSRQIRTDGIVWTHPWTRRGADTLHLNEGGPLNGIPDSLGNRLA

SEQ ID NO: 1024180 - protein, 265 aa, Homo sapiens
IYQLNSLFDHYSGSVINVNTNIEEKEEEVTEAIRETKSSKNELHSLSKMLEDLRRVYDQLTWKQKRHENQYLEAVNDFYAAKKTWDIELSDVAKDFSAISLACTKLTEDNKKLEIDINKITEKTNESIRKKSKYESEIKYLTIMKLKNDKHLKNIYKEAYRIGTLFHLTKHKTDEMEDKIAEVRRKFKGREEFLKNSLKVEWLLNGASKKLFSIYEVQALKRKSYKNRAFVPCPADLQDLCFNKDELKNRSQQELLLLIPIVKDL

SEQ ID NO: 1024181 - protein, 164 aa, Homo sapiens
AKAPCALSRIGRGPCEGVRRGRQHQLTAWGPKQRLSTSLLRDSFDRLPGDGPKKHSSHFAAEELIVQNRAPPEAHPILTSCRTLPCLAFTVCSEFFLKENPRKRTKGTKKHGKAILMVRRCREKRKRVTWKRGPVGANEQVESEPPGFVVLTKGVVRTVGGSPH

SEQ ID NO: 1024182 - protein, 167 aa, Homo sapiens
MRKETPASLVPPRGREWNLPPNAPDCMERQLEAARYRVQTGGSIHPSGASRPDVGCMMGRIPSGIFKDPLCRPATKAFCIRRSPKEAGVADLTWVGERGILVDIRIQVRDENLWEIDENETSYGTRKVHARYEAVMTLSHKASVLSVLEKRMSVDRKDIMNQRDKGP

SEQ ID NO: 1024183 - protein, 114 aa, Homo sapiens
MVWGTMDVTDIKVRNSRNPKNYVNKKKLFVLFTKYSLRIILLKMQFEECPWEELSKKYDCLTMVGQVISVVHFMSITSGFSGVLKISEIKNLKICAFQCYQKQYFLPKSKIKEI

SEQ ID NO: 1024184 - protein, 97 aa, Homo sapiens
GERCDPRTPANMALRVVRSVRALLCTLRAVPLPAAPCPLRPWQLGVGAVRTLRTGPALLSVRKFTEKHGMGNNRKCALEQWESAIFAQEALGDVVYS

SEQ ID NO: 1024185 - protein, 53 aa, Homo sapiens
SRKCYPSRTCYFLANVLSLGYTLSTLDKTFARITRSRDHTFASGTEARSSYIS

SEQ ID NO: 1024186 - protein, 411 aa, Homo sapiens
SGGWGGSGRDAPGGRCPLTSLGGPARAAPEPRQPRPPRPASHGPRAHTAPRGGPSHKRAAAERNDDGQSPQVFFKCCTKRLEVTLGSFLQTRPMSFTSSFSRLTMKGPLGCQHGKPQSSGEPGCSSAQREPPCFSSDGSMPGTHQGGVKLRESERPESSTAQIYTYELTVKKFGTDRRTETSKSSDIKETDVKSMEKPRLNTCTRRTAHNACRLLTRTLQQQTNADSIHRSRGGNTHSKRTKRTTYLERSMTGRREVKKDGHQEGSDTRSRKGAQRHRTERASNRKTTEERKRAQNERSKNTQNGDYRIAKPDRESAPSERDAYAEKRATTKRKRDHRQNEPTSEKRKDRAGHKHTCTTEDEQTIQTNRRQSGHKPAAGTNRRRGRRPHNRREKEDGHEKAPVEQSRQERE

SEQ ID NO: 1024187 - protein, 435 aa, Homo sapiens
SGGWGGSGRDAPGGRCPLTSLGGPARAAPEPRQPRPPRPASHGPRAHTAPRGGPSHKRAAAERNDDGQSPQVAQRSGVLRHPPEQRPRSVSVMKAIMAFASAVQSVLKLLWVAFSRKTHELHQQFLEVTMKGPLDVSMASHKALENQLQQRTERTSLLLFRREHASTHQGGVKLRESERPESSTAQIYTYELTVKKFGTDRRTETSKSSDIKETDVKSMEKPRLNTCTRRTAHNACRLLTRTLQQQTNADSIHRSRGGNTHSKRTKRTTYLERSMTGRREVKKDGHQEGSDTRSRKGAQRHRTERASNRKTTEERKRAQNERSKNTQNGDYRIAKPRRESAPSERDAYAEKRATTKRKRDHRQNEPTSEKRKDRAGHKHTCTTEDEQTIQTNRRQSGHKPAAGTNRRRGRRPHNRREKEDGHEKAPVEQSRQERE

SEQ ID NO: 1024188 - protein, 318 aa, Homo sapiens
ACVPAVSNLEPGVGFRTHPRRVTRPSCDPHNVQCRGSAVPPSSTTRPPSTPEGIAAGHTGSLLLMALLPIFFGAHAAPVRCARGKNASDDALKLITSRDANRFPIICHAGHSWGSTSFSRIFSQEYINLLLSMYFFVLGILALSHTIVPLHEISSSPGQLAKSTSTTLLFSTGFVGNNKEEIIDIYEFDTEGPVCAWCLSSIVGVWYLLRKHWIANEAFIGLAFSLNGVELPWTSTMSALAAFLLGGLFIYEVFLGNMGPMFMGDQWAPVPLTGTAIKHLRVFPRESGCEKGALKPHNLVPMLGPSAHVCHSHASLKY

SEQ ID NO: 1024189 - protein, 79 aa, Homo sapiens
RPPTTTKFAAASTSKPPASGDHWRSGMKTDKGIFAILIPVFCHLIMDLRGGTFCSNRVDGMLVIEETECLDCKCVGEEV

SEQ ID NO: 1024190 - protein, 128 aa, Homo sapiens
MGNTVLSHIDLRPTVCDSKRLRVIRERVETKSQPVLRYSRKGKPQLSLLCPALPSDGASNAEQGPHVVVSGYSDILPRGAVNSWPWKCKMAAPVNGGEWRPTKSLQDRATTKYAASSYLRLNAEQGEV

SEQ ID NO: 1024191 - protein, 43 aa, Homo sapiens
MGAPRWTTRNDVLVTSPILASNLYLIKLKEHSRYSEGPIPPGR

SEQ ID NO: 1024192 - protein, 38 aa, Homo sapiens
RAAPSLRSIESQPSTQGFVYEWFSARVDAAAVDAAANL

SEQ ID NO: 1024193 - protein, 219 aa, Homo sapiens
MGALGVRHKDKKWEDGYRKWVGPPKNPRKNINAGRRTDALGAHYHFGFPMEKPYTGNKNTIVAKKTLWTLSGVHHQEYPYFSRRPLFSGVSPHVCFIAHNGCPLWRPLEQRSWGWLIIIQRRGGVIHKGDLISPPGDHVATLCCVAQDTQRFWRAVMIRRPRESVGWRQSSPLVGGAIEPMTSVLHESHQGALFVPVYEQRLATRGVSPRRTQSLGRIR

SEQ ID NO: 1024194 - protein, 76 aa, Homo sapiens
MGRILINAENALFEGNLYRCRIDRFRFSNILIQVIAFKMIRRIAGPLRFHRRGVEIGAILEFAFPQFHGCKSMPSS

SEQ ID NO: 1024195 - protein, 157 aa, Homo sapiens
AGSVCGAFLARCVCTLHKTSKLSGPWSKAATFMSTVFINQPQYAWLKELGLREEKEGVYNGSWGGRGEVYYDAIARCVNKRATSKSLDWAYAVAGSIEDNCTEGRCIARKHGKNRGSDHSMASEAREEKEVDDRNWADGLAGEKDPIRHGIAWVFFA

SEQ ID NO: 1024196 - protein, 238 aa, Homo sapiens
MRERHSGGGEESREGLVAETIRVYYFEYRPKIMSKTTLDKSLLEIISDPDAGTPEDKMRLFLIYYISTQQAPSEADLEQYKKALTDAGCNLNPLQYVEQWKAFTKMASAPASYGSTTTKPMGLLSRVMNTGSQFVMEGGKNLVLKQQNLPVTHILDNLMEMKPNPETDDYRYFGSQRWLRGTRQIHIPRNKNIIAQKPLAFVVGGGNYIEYQNLCRLHKGDTRANTFYMGCRELFNAT

SEQ ID NO: 1024197 - protein, 87 aa, Homo sapiens
MPATGVKNANTGLINTVIRPIETTQTANQLSAFGNGNQRIFNSARSDWFVATTHTNLNIRGKENTCNEQAGIQLNLKKYANKVTLIR

SEQ ID NO: 1024198 - protein, 99 aa, Homo sapiens
GSITVVYRGREYNTTALRTRVEAAGQLVHSESVRTQYSVGRGSWSILCHARTLVPESVGIARGPHSSSDLGPTEAVSVGRPGGSCDANNVVGLTGKHLQ

SEQ ID NO: 1024199 - protein, 250 aa, Homo sapiens
ARRKLLSHGRLRAGFGGLRSRLPGLSRPLDLNPRPAATAPASLLFPFVAGGCRRSGRGIRDMPHSAAEHAERAPAASHHMMHVALVSKPCGTHVSFSGNQIGRDDTTKRRAGASNVSLARTSGPSLAFAGRIPARRFIYVEIAFFSRWWHQQTNATQEVVRDLVRQGRLEYANGGWVMNDEADSHYGAIVDQMTLGLRFLAGHIWPMMARPRVAWHIVTPFGHSRRGKARCLRKMGFDRLSSLGALIIKH

SEQ ID NO: 1024200 - protein, 211 aa, Homo sapiens
ARESSSSTAVSAAGAQQGGYEIPARLRTLHKPGDPCTPRQWCASEVAVPLVQGKALEDLGVKTSGSDDHPVIVATMLKHSWPFGVQRIRNTIQGDAGYTYCSDALRYSVRKLSGDRSSLRWPADFEYTIAVLYGKRREVRSKLEHVGCIHMSFLESPDDKGLSGEMDHAPDVTPTLGHRLDLVPCELVAQKRLDELVYRNVGTLVILSIVV

SEQ ID NO: 1024201 - protein, 94 aa, Homo sapiens
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 1024202 - protein, 129 aa, Homo sapiens
MFSISTPSKKSSKAEVAATAPAATAKNKHECEGHGYSLGCDIVCYSCSRYAVIISQPISSSNVSNVFSSTFILKDMIKFYLISQIRSYYSFSTEMVMFKILEMIIERNYGLHGIFIWLELSGKLLGNQF

SEQ ID NO: 1024203 - protein, 94 aa, Homo sapiens; identical to SEQ ID NO: 1024201

SEQ ID NO: 1024204 - protein, 94 aa, Homo sapiens; identical to SEQ ID NO: 1024201

SEQ ID NO: 1024205 - protein, 94 aa, Homo sapiens; identical to SEQ ID NO: 1024201

SEQ ID NO: 1024206 - protein, 96 aa, Homo sapiens
GQLSITLNLGNFLQLTDDPLYFDAYLQSLQVAAISTFCCLLIGYPLAWAVAHSKPSTRNILLLLVILPSWTSFLIRVYAWMGILKNNGVLNNFLLW

SEQ ID NO: 1024207 - protein, 89 aa, Homo sapiens
KQSMCAPIQNPAVLSSEDQVLAWLLLLGLLPMGILHVLCVPEEDMGNSGATSPRTAGPEQRALAHHQPLLPVPQEFILCCLARDPARRF

SEQ ID NO: 1024208 - protein, 40 aa, Homo sapiens
MQKLAGHGGMNLWSQLLRSLRKDCSSRGRKGCSKPRSRHS

SEQ ID NO: 1024209 - protein, 279 aa, Homo sapiens
MRMSHAKDRLCESNDLTFLLLPWWCSLEPWFVSTLVHVSMGVPEYSMLMENWHLVPYVRRTVHCEVQDDDRSTEGAAKIAFPSANEVFYNPGAWNSIWDLTCAVITEFARIQLGAKGIQIKVPGEKDTQKVVVDLSEQEEDKVELKESENLGLQETNLGTAAVGEICEEGLHCCWKAWQLQAYVSIRFALEVPGLRSVVANDASTRAVESHTPGMSSSMTVGHWYSRAKQIARIADVPAPEGCRRRFDVIDLDPYGKPSTFPVMQWCRLLVNDRVLCVT

SEQ ID NO: 1024210 - protein, 116 aa, Homo sapiens
VIILRKTRLDAPRLETKSLSSSVLPPSYASERLSGNNRDPALKPKRSHRKADPDAAHSHRILEMDKEENRRSVLLPTHRRRGSFSSENYWRKSYESSEDCSEAAGSPARKVKMRRH

SEQ ID NO: 1024211 - protein, 84 aa, Homo sapiens
SYPHYPPKGQELQLKPTSRDEASALKRIRYHGRGRFGIMGEGGGDYFVKLVEGPPPPPEPPKTGVAHAKEYIQQLRSRTIVHTL

SEQ ID NO: 1024212 - protein, 137 aa, Homo sapiens
PRYSRAQYDRVMEELYPRLKSLTLLARQYDIGINIDAEESDRLEISLDLLEKLCFEPELAGWNGIGFVIQAYQKRCPLVIGYLIDLATRSRRRLMIRLVKGAYLDSEIKRAQMAALEGYPVYTQKVYTDGSYLPCPK

SEQ ID NO: 1024213 - protein, 63 aa, Homo sapiens
MVIGNITGFTRVLSYALASLHRFPRGLLYDTVKRTIEGLDQSCENLHVLNVCPPHRRYSPQYG

SEQ ID NO: 1024214 - protein, 77 aa, Homo sapiens
ADVTSLPSLSSSGLSPSTNCTQDQLAKAQQQKEKQPIDEKNWECKTYRRVWCWEDETCMRKAKDLAFQTDGIVFYIA

SEQ ID NO: 1024215 - protein, 49 aa, Homo sapiens
MWRPRCECADNDKKPRVEKKEGRTRGVYRSTEEEQVYINTAPLGAKTKT

SEQ ID NO: 1024216 - protein, 75 aa, Homo sapiens
AQFSPIMPKADPEEPPAGATSRKSSPPEKNRESSFACSTMNKVPRTFSLLTSFRGTSGSRNSSAKFLGNLLSVKT

SEQ ID NO: 1024217 - protein, 75 aa, Homo sapiens; identical to SEQ ID NO: 1024216

SEQ ID NO: 1024218 - protein, 81 aa, Homo sapiens
AKVTMRRIILRHALKPALLPVLSYMGPAFVGIITGSMVIETIYGLPGIGQLFVNGALNRDYSLVLSLTILGGALILFNALS

SEQ ID NO: 1024219 - protein, 70 aa, Homo sapiens
QLAQKYNCDTMICRKCYARLHPRAVNFRKKKCGHTINLLPKKKHNKCLFSSVERAALRAQCPVGPWMPQI

SEQ ID NO: 1024220 - protein, 112 aa, Homo sapiens
VKMELEEESALGDGLWAAGGHQCKDRTHSSRPGMGRDPQVCASLALNRASIPRLHKGRHLSAPELFRPIPVPGMSLTRYRFCTSEKALDRQAESGRVSSGQYSGSGTSYAEP

SEQ ID NO: 1024221 - protein, 105 aa, Homo sapiens
LSSQKSHSPAVFVAGGAGLAHQLPVRCLELPEAWAALEDAETPHACSFSHLHLLVVMCVPYFKQSHQDYYFMATFSALHSLVSDLLSGIMLQTYPRSFPAVKVFW

SEQ ID NO: 1024222 - protein, 485 aa, Homo sapiens
GPSSLLLTCAGIAGIRALVSELGQSGNSGLLGKVVVATVHLSAQLFVGHVADYLIQSIKLVSVPLNYRQTFLYMYPEGDWILEGKPCLIIIVRCVNHPDPSPIMKHLGLPGDTPVVFSDLAVHVYSLFRIIYKKFQLRLCYRATMKQQWTVKLSWDSPDQGLNSSCEAQMFTVDSQMSYTRCPLWTLAFVCHPEVLPIYTELCLASKRKDDRPVANVVHRGHVLHDMGSASKPLDNLTFLQAVVERPEMLDMYKTRRTRSILCVQACAGAARRMNLNRCQVVLYPYTAGTLQQSAFIPGKAFRLATYYVAKRLILHGVGQCPCHLCAKHPGISLELSVSTSGPKPSSSSIPQHSYYLRSCSPLEGGSLSIILAQRSQAVCFGRPGKFTVFIGPSDLGITLFDNLGATIAKDRMVWTTWIKGRCLGTTGTLEAPIDTMEGGHRARTPTGTILNKGCGKAGMVPKKAEENRRAGTAKAGNQDTSDNT

SEQ ID NO: 1024223 - protein, 145 aa, Homo sapiens
MLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPATPPLHQKRRKKNLCLLKSGQTVDASYYGGRGVGGH

SEQ ID NO: 1024224 - protein, 104 aa, Homo sapiens
MHGLFWPFPTETRASIKNGTLSSVSLPAFKRLRCFSLRQGLTSVSRAFLRYNFPCLLLSKLELFISSLGNVDPLSHTYGNIIKHAVRYVVFIFINSLINPLCAQ

SEQ ID NO: 1024225 - protein, 569 aa, Homo sapiens
ASWCCPCGKTGRVDNECAHVSVATQPLCYTSPGARTMTTVIARWLRRTDTYHGCGEIPRMGCLDACARVWVVPVVTLRVALHQCVCGICVPGTTTAHNVSAQCTVVTTVIMGVVTWALGRSCLTLGPRSVRPQTLIYSVGSGAVDGRPHLLPYLPGDICAVAASSEPRHRGDRDRDLRMDPIAPTHGDPVHRCCARCYCVVRGTDPDHGLQPHECRGRWRCGDTKHLEEPLSLQELDTSSGVLLPFFDPDTNIVYLCGKGDSSIRYFEITSEAPFLHYSLPCSVPRSPSGGMGYMPKRGLEVNKCEIARFYKLHGAAGVEPIAIDSASKSRTWSQEDLYPTHRWGPDPGLTVLRSWLVGSGMLGPFLISLKDGYVTPNGAVESEGHTRGLVPGPQVGTQPSRPSGSSQLAMPCLVLEEADAEAPGPRVLEPHRSRLYTAGVRLFQAIVEPRMGLQSWSSQFASYPRSASACPVTIGRGRSPPYKDGVNFSCLKASRCGWPPFLGALLLGSGEPGVWSGPGPQGFFSAVFYQGEARGPPVARRFRSRGRSSLHEAPTDPALPAPARPPPP

SEQ ID NO: 1024226 - protein, 42 aa, Homo sapiens
MAPHDWVLVLILNTYGPNRSWDITWHIQTGGRIKGNMVVFCY

SEQ ID NO: 1024227 - protein, 250 aa, Homo sapiens
VGLREWWAAVAGWVLLTVAQFWAVVGTQTGDPYAPGPPSPRTFPPSQSFLLRNLHPLPVGCGTLGSRPGSAALTCGAPRAVNGARTCKVEKPGAICGGFGPGGLRTSSELWASIRRWTKLDFCPGQGASSWMQGVLACPQGVTGIDFPRRWTWPTDLLLSRKDGGEVEHHHKTRRRVADTVMLLFLACDSHSIIPFILDEHRRLTFDGTDTVVVSCAAGVTESAPFEKKAVRGFGQDPRVIRCIDQKSRS

SEQ ID NO: 1024228 - protein, 288 aa, Homo sapiens
VGLREWWAAVAGWVLLTVAQFWAVVGTQTGDPYAPGPPSPRTFPPSQSFLLRNLHPLPVGCGTLGSRPGSAALTCGAPRAVNGARTCKVDNVIPAGTMGEVGTRLREERPGLVIWPPNLLSILPVSSPHESLVPSVGALGQGVSGPAVSVGFNQALAKLDFCPGQGASSWMQGVLAAHKDNWHRLPKTMDLAYRFTALRKDGGEVEHHHKTRRRVADTVMLLFLACDSHSIIPFILDEHRRLTFDGADTVVVSCAAGVTESAPFEKKAVRGFGQDPRVIRCIDQKSRS

SEQ ID NO: 1024229 - protein, 44 aa, Homo sapiens
MAEMEFTEAESNMNDLASEYQQYQDATEKEEEDFGEEAEGGGLR

SEQ ID NO: 1024230 - protein, 56 aa, Homo sapiens
MSKVPDTDETWEYDGIKGTKSPVPVGPQHKNPAIPFVGNLWGSESLVGAQRQQAAS

SEQ ID NO: 1024231 - protein, 125 aa, Homo sapiens
AWQGRELAPGLERPWADAAPPPWQGAGLRQQGTAGAPETQTGCVRLNPRPAEPGGKSHVRSRQPWGSESALGSVQLSPPRLWWRGFEIIPAQGGWGLGTGPREGPRAPRGVLPPEPRDQAGLGQR

SEQ ID NO: 1024232 - protein, 69 aa, Homo sapiens
GPPCDRVQGPWGKGSSHVIFWDQVRGPLVLQVKGAEAGPQGAVEVARSGEKPLDFRGQADRVRGGVGIQ

SEQ ID NO: 1024233 - protein, 306 aa, Homo sapiens
SGVRWLDGRRQERAGRGEGRGGIENGVGELGSGVLRPRPGWGDGGAASPPPIKPPYNLLPRPSCVRLVNQPAHICSILLWTVPVAEGLAYRRPLSRVPDAAQPRPGLGVRWRDLRGPGPTPDALRKPPCFTMLSSRAGQASTAFRKCGAAAGRGSGETGKADGAELTSRSHKPVNFLRAYQCHRLSQCTVKSASSSCQTEAKSGGPACERARACAAQGASERLLITSASADTVANCSTMQTAARPTGPPCPSRTDQLAVATISPGHSVEIVCLLYSCVSTPIHDHSTYPLNGLDPDPVPHTIWRTP

SEQ ID NO: 1024234 - protein, 175 aa, Homo sapiens
EFGTRQGTNKRWSSYVDPSAWLQMRLDICHCCAPPAEPPMDYEDDFTCLKESDGSDTEDFGSDHSEGCLSEASWETVDKKETEVTAGFQTIWHHTCYNCDCEFWVANEDTIAEIVGMYVLDAATKLPIPDSNSMTSSRLNSCYDKFKSFVPGTYDHSENPLYSQLMRGEPAILEV

SEQ ID NO: 1024235 - protein, 301 aa, Homo sapiens
FLAHKDEEWCRSKYHPDEVGKRRQEARGALKTELRVFLSLMETGWFDNLLLDIDKADADVKMLDAAVIEMEGGTENDLRILEQEEEAEQAGKPGEPSNEQKKDGLEHGLGARGAQKQRHTDDERTDIDGKQAENDTFYTDDKNNTNVGRVMGTQDPHATNRTTPEKEGHKHGVARQRNRNAPGRDDSFAERHACQEPARRESRAAGPGCRTQTGRRPNQPLHQEEREDSPTGNNHTGDERATRRHAGARDVEKTARSRAYEPGLPRHTCRHNSAPKAPAGRTTSPPPVQGDPGTTAGARQR

SEQ ID NO: 1024236 - protein, 52 aa, Homo sapiens
QSSSVPYLPGHLAESQYGLVELNREAIAKARVIGNPGCYPTTVLLGLAPLLD

SEQ ID NO: 1024237 - protein, 271 aa, Homo sapiens
LGKAGAPGLSHLFPSPASLSRSAGWTRWRSGCSTRDRPWVADSRQSLGRRGSGLKPRQVATRPDQGRSLPAGWAVGEGAAPVPRPGASGAVPRERRVRRRTEKTSSKVVRNGTCPYSRAAADFHLPPGLGIQQYGADALDAYGALLWEEAGTTGSLGCPAAPAGPHRVDTEAPGPFRHLWTAQECCWAPSSSSSLEGALAHPDRIIFPNHACEGPPQHVLLEVQGTLQRPLVRDSRTSPANCTGLILGSKEQTVTIRFQKLHLACGSERLT

SEQ ID NO: 1024238 - protein, 246 aa, Homo sapiens
MKPVEIVIARAVYSMVEFNGKLLASINSTVRLYEWTTEKELRTECNHYNNIMALYLKTKGDFILVGDLMRSVLLLAYKPMEGNFEEIARDFNPKLDMTLLVENLGTELTKLPGEAEHCPINIARDVTKGERCHHLPQGAGNTFQEEQNINHHRSTLWQKGIATGSPGNYNNSQGNELTTRNDRAQEAPQQNGNQRRATRDSRQPLAQNTQGANTSQHENSENRTTTRPHQRRKHHKRTLGTPQTHA

SEQ ID NO: 1024239 - protein, 364 aa, Homo sapiens
RQALRPSASYPGSVQQCKLQQAVLQQHCFLMRPPLEKEVEVHRSYLIIDLTTAIGECVMPTRFLQNEYAQAEFRLQGMWLKTPNIYFIAGHSNVCILIEAEPKQGRIVVFSGIRMENYRLWLNKEVNGAVYSMVEFNGKLLASINSTVRLYEWTTEKELRTECNHYNNIMALYLKTKGDFILVGDLMRSVLLLAYKPMEGNFEEIARDFNPKLDMTLLVENLGTELTKLPGEAEHCPINIARDVTKGERCHHLPQGAGNTFQEEQNINHHRSTLWQKGIATGSPGNYNNSQGNELTTRNDRAQEAPQQNGNQRRATRDSRQPLAQNTQGANTSQHENSENRTTTRPHQRRKHHKRTLGTPQTHA

SEQ ID NO: 1024240 - protein, 217 aa, Homo sapiens
MRREDEEEEGTMMKAKGDLEMKEEEEISETGELVGPFVSAMPTPMPHNKGTRFSEAWEYFHLAPARAGHHPNQYATCRLCGRQVSRGPGVNVGTTALWKHLKSMHREELEKSGHGQAGQRQDPRPHGPQLPTGIEGNWGRLLEQVGTMALWASQREKEVLRRERAVEWRERAVEKRERALEEVERAILEMKWKVRAEKEACQREKELPAAVHPFHFV

SEQ ID NO: 1024241 - protein, 217 aa, Homo sapiens; identical to SEQ ID NO: 1024240

SEQ ID NO: 1024242 - protein, 217 aa, Homo sapiens; identical to SEQ ID NO: 1024240

SEQ ID NO: 1024243 - protein, 102 aa, Homo sapiens
EHVTVQVVVVRKREGLLHSSHISEELTTTTEMMMGRFERDAFDTLFDHAPDKLKRGEEVFFITFVNKHLNKLNFGGDGTWRPQFCRLCTWFCSWAFLEDLTF

SEQ ID NO: 1024244 - protein, 182 aa, Homo sapiens
MDTAGQAGGHAASSPQISQPQKGRKPRDLELPLSPSLLGAPGAERTPGSGTGSGLQAPRPALTLSLLPTHTLTPALLTPSSLPPSVHFRSSLSPAAPRSPAKLSCQLPSSGGAQVHIPSIGVAGLSTPAVLIARAPEAMTTTSTTTPSGVLHPCSLKEKHSSTERLMLMWWGGDPWEGFLQE

SEQ ID NO: 1024245 - protein, 76 aa, Homo sapiens
RIPDGEHMPSDCGKVWSDRARMSDDGWRVLCSSISVSKITHTDISIPTTVIPTILSCNNHGRRIDKTSVTTSATPR

SEQ ID NO: 1024246 - protein, 314 aa, Homo sapiens
MKMLEFVQHNSSSEKPSEKSFQNCVKRASAGKRFEEKVLNCLVFSVGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 1024247 - protein, 350 aa, Homo sapiens
AEGPPQRRGGAQICFPSDSICPGPLRERKVKFALALPPAQVLGGLDLRLPGPGGSLESLRPNVVSLSDLGRRAALLTRQPLLGPAGPLVPPRVPRDSHEAPLHEHLLNSSYACFSLDPALKRTACVPGLTTLICLATLAIVSHLISRVANCNTVVDVAVTTMNDADLPSGAPGLWPPLSPITTMHLRMSEGGQSLTLQPHRPVPGPPGVSSPPVNDTYGHDLTSPPSHPRVAHGPAGPARTSDCLLVRPLAPVTPPPWPGPRCTVLPSLPRLLPRISGSLRRADPGNAPPSSPCPSSYARFLGARSSPCPAVLPPPLPARGALPPSPLPPSLLPAAPVSPPHARARPPAP

SEQ ID NO: 1024248 - protein, 100 aa, Homo sapiens
GPVREVRQLRREFEREPRAPWIEQEGPEYRDRNTQIYKAQAQTDRESLRNLRGYYNQSEAGSHTLQSMYGCDVGPDGRLLRWDDQYAYEGKDYIALNDDL

SEQ ID NO: 1024249 - protein, 221 aa, Homo sapiens
AECRLPSFRTARVSASLRAREEGSQAEPRPYRRRRHVAPRPRPDPGNPKPAGGSRPVPQWSPGSEPLLAGAGFSICSLKGRPPAGPSRVSSFITFICYVASSASAFLTAPLLEFLLALYFLFADAMQLNDKWQGLCWPMMDFLRCVTAGLIYLCYLHHRTIAKLPRTGAVQSRMEAVGILDTIVYATDCLPRSSTTCATLRHTRETLPAEHPKPTKTRSNQ

SEQ ID NO: 1024250 - protein, 206 aa, Homo sapiens
AECRLPSFRTARVSASLRAREEGSQAEPRPYRRRRHVAPRPRPDRTELPGSVRPGPGLGCAARSLPQAPVASRVSSFITFICYVASSASAFLTAPLLEFLLALYFLFADAMQLNDKWQGLCWPMMDFLRCVTAGLIYLCYLHHRTIAKLPRTGAVQSRMEAVGILDTIVYATDCLPRSSTTCATLRHTRETLPAEHPKPTKTRSNQ

SEQ ID NO: 1024251 - protein, 298 aa, Homo sapiens
PGAWTPRDLLDVGCDCCSEYLELKKALGYIERQSVQQLMKVNSSLSDELRRLQREIHNAAVLDGTLHAPCMPPCGLVPTTSTPHVNVAEHTPMAARAGVIDTCRDRQAFSMYEPGSALKPFGGPPWGRAHYAAAGLSNSTELEDDGQSSSVTRPWLSRLPGSGKGVSDSDVPFTPSSPLLYLLPGGKPGTTSNAFPPRQWSLTVTYDEPAEVGTQCWGWKWKRYSRCCGKEEDFQSRAGKPGWRPRILGFPSTEGCHLEGPMQVTKNIQDTVAGPATSSSMTRFVPCSEKIHFGVTRD

SEQ ID NO: 1024252 - protein, 86 aa, Homo sapiens
DLDDRYTVVYRHPFVDKDVEDGMERWVGGWVQLTSRVPFTSRIIQFWTTRELGTSCQPGHMHEVGNEQYPMEALFSLPLGVNELYP

SEQ ID NO: 1024253 - protein, 60 aa, Homo sapiens
RQAAAGVSCSSHNLGTPQAQLETEYEEVARRLAWEAGADLVLSNDELALSGSSTSSFLVM

SEQ ID NO: 1024254 - protein, 146 aa, Homo sapiens
MTRRGAARPPQSRQKENHCAHSTTWCPPREDSNREAEDNTDGGDEEDPHHHQKEQTTPPARDHHTERASMMLKAKNNTPEKSREHTIEEGTQHRRGAQDTQITQNEEDHTTKAEEDPNENQEKDNTPPPVEGANQRAEASARPTSH

SEQ ID NO: 1024255 - protein, 768 aa, Homo sapiens
PRVPQTGGGSLRPASYSPRLPAPSPSAPLYPQSARPSAAPFGTEVSRCPARRRSRVTAASSAPQRRPPGVRRPRRSGSASRASPGSPRSSLSARPARSLRFVSRAQSAEPSGARWAVAWATPNAARALTRVRWPAHSRTMTAEGPSPPARWHRRLPGLWAAALLLLGLPRLSVRADGKLFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGSPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTDGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 1024256 - protein, 216 aa, Homo sapiens
GSTRLGLNRPREAPAAGLFLLLLLGTWAPAPGSASSEAPPLINEDVKRTVDLSSHLAKVTAEVVLAHLGGGSTSRATSFLLALEPELEARLAHLGVQVSREKMQDREQFWKYVKPKLPGYTVGDSSQLKLPVALDPGAHHFSLIVDNSPTPIVASSTIPTPDSPSPENTSSVVFDGEPLHFYSSLSKGRHQPMRVKLGSRNVESYTKLGNPSALRT

SEQ ID NO: 1024257 - protein, 219 aa, Homo sapiens
MAYYTTRYGAGVIGPEAPAAGLFLLLLLGTWAPAPGSASSEAPPLINEDVKRTVDLSSHLAKVTAEVVLAHLGGGSTSRATSFLLALEPELEARLAHLGVQVSREKMQDREQFGKYVKPKLPGYTVGDPSQLKLPVALESWRPTILTPRGNQSYDPLCFIHYSNPRFTQSRDTSSVVFEGNHFISTLPYPKEDTTMRVKLGSRNVESYTKLGNPSALRT

SEQ ID NO: 1024258 - protein, 224 aa, Homo sapiens
AGYRARALPALAQLLFPVMEAPAAGLFLLLLLGTWAPAPGSASSEAPPLINEDVKRTVDLSSHLAKVTAEVVLAHLGGGSTSRATSFLLALEPELEARLAHLGVQVSREKMQDREQFWKYVKPKLPGYTVGDSSQLKLPVALDPGAHHFSLIVDNSPTPIVASSTIPTPDSPSPENTSSVVFDGEPLHFYSSLSKGRHQPMRVKLGSRNVESYTKLGNPSALRT

SEQ ID NO: 1024259 - protein, 162 aa, Homo sapiens
GSTRLGLNRPREAPAAGLFLLLLLGTWAPAPGSASSEAPPLINEDVKRTVDLSSHLAKVTAEVVLAHLGGGSTSRATSFLLALEPELEARLAHLGVQVSVGDPSPPLPGPFPPPFLAVPDSSPGPLGLRKCGDPGGGRGTGGPWDCLGAREESWVARGPGAS

SEQ ID NO: 1024260 - protein, 100 aa, Homo sapiens
TGLSSIMVHGSELHHGGTGLSCIMVARAELHHGGTGLSCIMVEKIEDPVYGIYYVDHINRKTHYENPVLEAKRQTQRELSGFTPIQSLSVLPKELALCQD

SEQ ID NO: 1024261 - protein, 118 aa, Homo sapiens
TGLSSIMVHGSELHHGGTGLSCIMVAPGKSKLETTLEEAHTLNRAAWDSDTLLFSLVSTQYPLSSLQDDHLASKVPHGTVEQGPVSELLTTMGHETPLVPQMVYTLRIITKLKRILSN

SEQ ID NO: 1024262 - protein, 68 aa, Homo sapiens
IELVPPQHVPAALAILDDQDFLIHFRRTVYPAVVLATWGTPMRVTNRCQLNTKKLKLGAHVRALKDGV

SEQ ID NO: 1024263 - protein, 73 aa, Homo sapiens
SQSLEIAEHAVSVTSVWEVCRWVKRRSFHSDTSLILSHGVMFGNFIYLNLVFVLRVGKMSSHYISAFQPDPVG

SEQ ID NO: 1024264 - protein, 52 aa, Homo sapiens
CALGRRIRELTAVVQKRFGFPEGSVELYAEKVATRGPIFRPEDWTSLAVPKH

SEQ ID NO: 1024265 - protein, 184 aa, Homo sapiens
MSPTQWDFPVELCCRPMAFVTLTGLDVVYNAVHRAVWDAFCANRRADRVPISFKVLPGDHEYPKCRPKRASYEWYIPKGILKTGWMNKHLSSGASPGGCVTMKLDWDEPQWKEKQSEVRHQSGNSQAKVYKEETQKVAVVSDSARKPLWPQGEDVIASGQGCSFMHMHVNSQESLSKTLPHTDQ

SEQ ID NO: 1024266 - protein, 260 aa, Homo sapiens
MSAVAVERPARSRTESWRQEPQGHSVSLKLPPPAPVSGRSRGRKSSRAKKRGKGRAKARVLPAPDGRPLGAPDPSQYHESRGKTPIAGTVCRLAAGVRVALEGQLQSCCMILRARGRMACLPGSPLGLVGLSCLLGPELAEGTTGRPLPGPGLGKAASSLRSDLAADTGLRGNQREPVLNGRQNAPEEFEKPGVGPMTGERQGPQEKPGRHQQGDSGPSGSIGWLENGRTPKGGGNGEEYLVRPPGGGQRKEQRECKVRA

SEQ ID NO: 1024267 - protein, 62 aa, Homo sapiens
MIVKKLTLPKDFLWGGAVAAHQVEGGWNKGGKGPSICHVLTGGAHGVPREITKEVLPGKYYP

SEQ ID NO: 1024268 - protein, 89 aa, Homo sapiens
KLADAYLSISHQINARFQRLTSECDPKTHTDYGLKDRMTHVHTYTLYKLHVTPYVKNTNLKAAHSNSDGPPKLLRLQSASRPRPPSDNF

SEQ ID NO: 1024269 - protein, 40 aa, Homo sapiens
DQNELVTIALEDLRRIPHERSKFSTVFAEWPLQADLREHT

SEQ ID NO: 1024270 - protein, 82 aa, Homo sapiens
MRRNHPCNRDKTGCRYNFLVFVLTVLKGATITVLEAWENAFFHFSQIGHGSDNDAVGFFSVSWLPCWLTCNCSSTFSPAFLR

SEQ ID NO: 1024271 - protein, 72 aa, Homo sapiens
MGGLLKFIRGLWTEEKENQPGDPQEKKSPQDGVPDTQKSKKEATQEKNRPDQKTPEVDSTTYGEKQIRSIVT

SEQ ID NO: 1024272 - protein, 162 aa, Homo sapiens
GLAGFGSSCGGGCRAWGRGRPRPPSQPPRLARLWLRSAVPFSGLPSERLARTSCSRRSRPSPAGPFPPGGLTGAEFGPAAGTFAAVPLAGPRLGVAGAAGTVFSWFHLVQPGTHKARREEAGLTACVPVTTRNRDNVGSRAPVWSPNGPGEFLLGNKFQGAW

SEQ ID NO: 1024273 - protein, 74 aa, Homo sapiens
MSVPLYIHLAGSQGRQDDQRIGSAFIWLDDGQLRIRKIQLEESKITPFQRTTRQQLMALANAPFNEALPSPDLR

SEQ ID NO: 1024274 - protein, 165 aa, Homo sapiens
ETSVNFQWIQMDIICLPQCDLFKIEDEQNECHWIHEVTRLPCPEYLQCSSSYSTQWVHGRERADICMRSTTNSAPSLCPSRSNELCLYHQRYCSRVSCAKGSRRRLLDRSVAYEARVVQEWTQEKKGSILKNCCSSHPEAFVALTKREARRTAEKHGKNDVKLCA

SEQ ID NO: 1024275 - protein, 239 aa, Homo sapiens
VAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEAGKYVTEVNSITETPVLEKHHYFEKETTETPVLDEASLLEKETTRFFFFSKNDERLQGSDLFWRGVGSTMSRNSWEARTTKLRMDCRKE

SEQ ID NO: 1024276 - protein, 139 aa, Homo sapiens
MSAATQRARAGGGAMACAGLLTVCLLRPPAPEPSPQTPREPQLAPELVARRTTLFQDVPQGQMMMGSSHLRNSRPYFADGVLSLGGAAGTVSGIDGHLTDNLETEKLCDYFSEHLGVYRAVLAALESLNRAVLAAWMPP

SEQ ID NO: 1024277 - protein, 72 aa, Homo sapiens
TELCCGFEDELAVGVRRLVDVPEHGKCEFWLVWDLTEQFSWMGLFSTRVRVLLDLLTCNFVTAKEKRERQQH

SEQ ID NO: 1024278 - protein, 119 aa, Homo sapiens
MGLYRSVGVRQGRREGGGSRSGGQGGIVPGSGPSTQTPLTFTPALCSLRRLRPSMSSTGRHTPCEHRTQATLACPGARRQLPRNFLGERALGLPSPLRVSKWDDSRPRKTRGSLGLPEL

SEQ ID NO: 1024279 - protein, 87 aa, Homo sapiens
VHAHRTAVGVAISAGFLALKICMIRRHLFDDDSSDLKSTPGGLSGEGCGARAWLCPTQRGTEGHSVMLATARMNPQAQSPTGCKGRQ

SEQ ID NO: 1024280 - protein, 188 aa, Homo sapiens
RYGSAEMAEVEETLKRLQSQKGVQGIIVVNTEGIPIKSTMDNPTTTQYASLMHSFILKARSTVRDIDPQNDLTFLRIRSKKNEIMVAPDIRLFPDCDSESNRISHSLGLPVSFLNLMPPKNVNVNHVSGTSTWAVAWNPLTPIQWTVCGLGGSSPPPREPLCAPPSPELGAPLSFQFGAELQEPHQFF

SEQ ID NO: 1024281 - protein, 246 aa, Homo sapiens
MNGAFCVDSPCFDDLMVKKSWRQYSGRCLRRRVGGYSEYSSDSLASSEVPELICLSHTDATRESMVKLSSKLECRMSFAGEFGSPSTDASASRCPTAIFAFEGIGDEDLYMLHCLDVRALLPPEEFDRNLSLVVLVVPTVSKEAEGVFLTLLLFRTRTRCFIRLDPRGPRIRTIAVVTIGLVCNRGLPLLFSELALDAKLAFSIIAQSPKGIHGWPALGRNISPSGQLHGLLEPWAKGHKRNRERY

SEQ ID NO: 1024282 - protein, 138 aa, Homo sapiens
MEDGLLEMTKDGGDMPAPLEVSTVPAVGDVISGEYNGGMKELMEHLKAQLQALFEDVRAMRGALDEQASHIQVLSDDVCANQRAIVSMCQITTAPRAAGVVGGKGSFQSDPQEPETPSPGIGDSGLLGRDPEDEEEEK

SEQ ID NO: 1024283 - protein, 357 aa, Homo sapiens
TSRTSATTTESTNSSTNATTTASTNVRTSATTTASINVRTSATTTESTNSNTSATTTESTDSNTSATTTEGTNVRTSATTTESTNSNTNATTTESTNSSTNATTTESTNASAKEDANKDGNAEDNRFHPVTDINKESYKRKGSQMVLLERKKLKAQFPNTSENMNVLQFLGFRSDEIKHLFLYGIDIYFCPEGVFTQYGLCKGCQKMFELCVCWAGQKVSYRRIAWEALAVERMLRNDEEYKEYLEDIEPYHGDPVGYLKYFSVKRREIYSQIQRNYAWYLAITRRRETISVLDSTRGKQGSQVFRMSGRQIKELYYKVWSNLRESKTEVLQYFLNWDEKKCQEEWEAKDDTVFVEA

SEQ ID NO: 1024284 - protein, 148 aa, Homo sapiens
AISRRRLLQGAGAMWLLSVSQVSLAAVSQVVAVRVWPASSYTRVTVESNRQLKYKQFALSNPERVVVDIEDVNLNSVLKGMAAQIRADDPFIKSVQTGTNRTDNYRAYNLKVRRVKRQRQVHQAAIGLGVRREAHVVFHVTRAEVFFM

SEQ ID NO: 1024285 - protein, 209 aa, Homo sapiens
GWTRPRASATRFCHSMEDGLLEIMTKDGGDMPAPLEVSTVPAVGDVISGEYNGGMKELMEHLKAQLQALFEDVRAMRGALDEQASHIQVLSDDVCANQRAIVSMCQIMTTAPRQAALGVVGGKGSFQSDPQEPETPSPGIGDSGLLGRDPEDEEDEEEEKEMPSPATPSSHCERPESPCAGLLGGDGPLVEPLDMPDITLLQLEGEASL

SEQ ID NO: 1024286 - protein, 71 aa, Homo sapiens
LNFIGKYRLTGVHRRKDLAGTHIDDAQVHGNLIELVLRVGTDAKISCPNPARFDVAFITDNRTFNHDICRR

SEQ ID NO: 1024287 - protein, 86 aa, Homo sapiens
FFIDLFLCWGLTTPERRNPAATFTRLLGKYFIIAIRLSVHDRNIATAVPTQKNLKNQENKSDVGFLAKKLSPIDDRLSHTKVKYSY

SEQ ID NO: 1024288 - protein, 182 aa, Homo sapiens
MLVPWDYRGEPTRPAQQWLLCGKKVRAEGPWEDAPPNMSSLIVGKLPMFAQPFSPIRASKRMAKVSSNNFASLPRQAPMLLFCPLWMPVTSVPQEAKLLRQLKFSQGTGVCVLIYTPLHTYFFKLSPTLGTPVLEYPQQFKGKKRLKQKDFFLPKLCLLAWGPRHADLKINQAWVGHGGSRL

SEQ ID NO: 1024289 - protein, 117 aa, Homo sapiens
VYYDETAQEIVDEFAMRYGVESIYQAMTHFACLPSKYMCPGVPAVMSTLLANINAYYAHTTASTNVSASDRFAASNFGKERFVKLLDQLHNSLRIDLSMYRKLPSQQPGETPEPHDG

SEQ ID NO: 1024290 - protein, 46 aa, Homo sapiens
MGISGRFLLLAVALVIAAAAVAADEQAAVDLAGPGEIAAGVKEAAE

SEQ ID NO: 1024291 - protein, 139 aa, Homo sapiens
TICQIINLFFDPRDSIFREDRRGANFACLVANDQLIVFDPDGAIRQVMRQCQRATYRDRLIEMLLIHLGIVLRALGTDWRFHNMHQRIFVRFNAVAERVQFQCGHGCYPRKVAVNPFWQAYCWAKSSSSGASSGFPGAS

SEQ ID NO: 1024292 - protein, 88 aa, Homo sapiens
WLNSYMILKKNKGGRLTLNITPYVEEAPRASTPLPPSMLSCGLELMTQANLEAVEVPPSQSPQAVMLVTTVILATAKQHAPKDTNSKE

SEQ ID NO: 1024293 - protein, 226 aa, Homo sapiens
RRPPARCCSGEWPPSTRPALLRRASAHPPPQPCGNPACGAEWGASTSGEREWQPLATEDDRRLPPGAATDKQFCWNHGNKCGKYQRTREGHGVDLLGRWTAVAAELQRRLVVGMRLCAPVLQPRGGWEFQMTTSNTAVTSRARRRRLVCGALARATDGKRRSRGGRRAHCCATVREAGSADEDDQMLLGRAWALSSFFFCEMNARSYGLKAMYRVVGQVTNPNVGR

SEQ ID NO: 1024294 - protein, 95 aa, Homo sapiens
MYTHFPNMVYTYMYAIFVNLKKKRHLSQTKQPMFWDGSHVYYKRTSRDEGGWGFSSSPAASAPGRPTQGQSLGIMRRVQPAVLLVNVEYGLPVTE

SEQ ID NO: 1024295 - protein, 59 aa, Homo sapiens
MTISSKRQQLYVASAVGVTHLSLHRCQAYGAACADCCLAWDPYCAWDVQACSGYTASSK

SEQ ID NO: 1024296 - protein, 135 aa, Homo sapiens
CRNKGKGAYRIEYTYGFTEIVNVPSRTVVRKGCCSSATTGLLASRGRHLIIRSAITLSPHCRRTGTAHTGCTGWSIMQQADFAADILFLLCGKDISTAGGSALSDWLITNSIFMPVCFANHLTVKVLISRQCPII

SEQ ID NO: 1024297 - protein, 81 aa, Homo sapiens
STVVYRQHSYQTIDFKTKDIKKDKEGHYLMIKGSIQGEDVTIVDIYAPNIGAPRYIQQILTDIKGDIDGNTIIVGDLNNHL

SEQ ID NO: 1024298 - protein, 70 aa, Homo sapiens
MAALAASMATSTAFAAKPRLARPPARLSVSCSASSGDNNTPSLSASIKTFSAALALSSVLLSSAATSPPP

SEQ ID NO: 1024299 - protein, 112 aa, Homo sapiens
LRLWTQSRCGEEIAVQFVDMVKGKSLHGGCDLPKALPVPFSPENNALDLVLADSYWVTLDCDAWAWVPQEDQSSVITTWDTSPEELLGNLPNAPQVICRGSVKGGFPSQGGL

SEQ ID NO: 1024300 - protein, 130 aa, Homo sapiens
ETQLVVDGGGKKMKQVLKLHSLIAPTLLEDGIMECCHTFEQFLQERITVNGKSWATLVEGVVTIEKEQDAMITVTSEVPFSKRYLKYLTKKYLKKNNLRDWLRVVANSKESYELRYFQINQDEEEEEDED

SEQ ID NO: 1024301 - protein, 130 aa, Homo sapiens; identical to SEQ ID NO: 1024300

SEQ ID NO: 1024302 - protein, 167 aa, Homo sapiens
MSSRPSSAVPNSASLSEDQSSDRSKFPKADDLIDERDRKLTELYCVSRLNQLLELTDENKLRKEIDAFLKKNDIRRGIRFDEASLPKLLHTAATPITKKKLKDVNLINVPNQRLSDSKMSRELPDNSENVSVKSESHFVPSHDNSIRENMVDSLRPAEKTGGMGTKG

SEQ ID NO: 1024303 - protein, 204 aa, Homo sapiens
MDPLRLLLPRAQAQPLLPLPAGVPAPSVRPRLVPRRRARRHRNGAARMLPASAVASESPWTEQDPPSGEKEERFDWLDQWYPFAPVEDLDPGAPHGKMVLGIRVVAWYDRGAGEWRVFEDACPHRLAPLSEGRIDDKGRLQCVYHGWCFDGRGACKFIPQAPALGPPVHTNSKACVASYPCVVQNKLLWFYPRAGPEHSDVLQR

SEQ ID NO: 1024304 - protein, 108 aa, Homo sapiens
MTISTLSNETTKSGSCSGQGKNGGKGFTYGKKCFTKEEWKEQVAKYSAMGELYANKTIHYPLKIQPNSSGGSQDEGFATIQTTPIEPTLPRLLLNYFVSMAYEDSRGG

SEQ ID NO: 1024305 - protein, 46 aa, Homo sapiens
NILFNPVPTLTVRGKEQWLPVEATNADPRPSPQRRSAKPEAQGAAA

SEQ ID NO: 1024306 - protein, 505 aa, Homo sapiens
RPVDAWVRARSRLGADLHPGAAGGSGACTPLRSSGGRRGGGAEAAGKGGVPAMERAVEPWGPDLHRPEEREPQRGARTGLGSENVISQPNEFEHTPQEDDLGFKEEDLAPDHEVGNVSLKPEGIQNWDDLWVQREGLGKPQPRDRGPRLLGEPRWGQASSDRAAVCGECGKSFRQMSDLVKHQRTHTGEKPYKCGVCGKGFGDSSARIKHQRTHSGEKPYRARPPAQGPPKIPRSRIPAGERPTICGECGKSFRQSSDLVKHQRTHTGEKPYKCGICGKGFGDSSARIKHQRTHRGEQPPRPVVPRTAAISGSTAATQGPKAQDKPYICTDCGKRFVLSCSLLSHQRSHLGPKPFGCDVCGKEFARGSDLVKHLRVHTGEKPYLCPECGKGFADSSARVKHLRTHSGERPHACPECDRTFSLSSTLLRHRLTHMEPQDFSFPGYPLPALIPSPTPPPLGTSHPLTPRSPSHSGETLRPAVALEPKSLGAQKAEEASSHTARGKAT

SEQ ID NO: 1024307 - protein, 576 aa, Homo sapiens
RPVDAWVRARSRLGADLHPGAAGGSGACTPLRSSGGRRGGGAEAAGKVRCGVLRAGEEQQVQVAAWRRVAGGHLGAAARTMGPDAARCPALAGRGQRQGAAGHTWLRDLRDAVCPLAQGGVPAMERAVEPWGPDLHRPEEREPQRGARTGLGSENVISQPNEFEHTPQEDDLGFKEEDLAPDHEVGNVSLKPEGIQNWDDLWVQREGLGKPQPRDRGPRLLGEPRWGQASSDRAAVCGECGKSFRQMSDLVKHQRTHTGEKPYKCGVCGKGFGDSSARIKHQRTHSGEKPYRARPPAQGPPKIPRSRIPAGERPTICGECGKSFRQSSDLVKHQRTHTGEKPYKCGICGKGFGDSSARIKHQRTHRGEQPPRPVVPRTAAISGSTAATQGPKAQDKPYICTDCGKRFVLSCSLLSHQRSHLGPKPFGCDVCGKEFARGSDLVKHLRVHTGEKPYLCPECGKGFADSSARVKHLRTHSGERPHACPECDRTFSLSSTLLRHRLTHMEPQDFSFPGYPLPALIPSPTPPPLGTRHPLTPRSPSHSGETLRPAVALEPKSLGAQKAGEPAATLRGGKPP

SEQ ID NO: 1024308 - protein, 478 aa, Homo sapiens
RPVDAWVRARSRLGADLHPGAAGGSGACTPLRSSGGRRGGGAEAAGRGARTGLGSENVISQPNEFEHTPQEDDLGFKEEDLAPDHEVGNVSLKPEGIQNWDDLWVQREGLGKPQPRDRGPRLLGEPRWGQASSDRAAVCGECGKSFRQMSDLVKHQRTHTGEKPYKCGVCGKGFGDSSARIKHQRTHSGEKPYRARPPAQGPPKIPRSRIPAGERPTICGECGKSFRQSSDLVKHQRTHTGEKPYKCGICGKGFGDSSARIKHQRTHRGEQPPRPVVPRTAAISGSHGSYPGTEGPGQANICTDCGKRFVLSCSLLSHQRSHLGPKPFGCDVCGKEFARGSDLVKHLRVHTGEKPYLCPECGKGFADSSARVKHLRTHSGERPHACPECDRTFSLSSTLLRHRLTHMEPQDFSFPGYPLPALIPSPTPPPLGNSHPLTPRSPSHSGETLRPAVALEPKSLGAQKAGEPAATLRGGKPP

SEQ ID NO: 1024309 - protein, 171 aa, Homo sapiens
RQAVPDTPHLKVPIRAEACRRIQAGYTLGNVDVTIIAQHRRCCRIIPQMRVFIAEDLGCHMDDVNVKATTTEKLGFTGRGEGIACEAVALLIEGNKMIEDNLTYLHGKPQGTGLLKANPEDFVVVEDLGFEPDGEGEHILVRILKNGCNTRFVADALAKFLKIHAREALRW

SEQ ID NO: 1024310 - protein, 94 aa, Homo sapiens
PSRSVGSLWRLLPRGPHEQQPLVLGLQLPVHGQREAEEAPGVSIFPDHVVLPSVQVEGCAEPGQEPRRQVEQAQLPGGGHGRTHGEGSGDLQRP

SEQ ID NO: 1024311 - protein, 101 aa, Homo sapiens
HPGTTLPANPQQRCGDPERHPSPKHTREAQQSVPPAGVPANTPGGKNRRKALCLKQKKNCQCMASEKPKRLPGSPYFRITLSSRVSKLKAAPSRDRSPADR

SEQ ID NO: 1024312 - protein, 88 aa, Homo sapiens
AREHENEWIPYEIPLDLTVEPAHAPKHPVLHPSFKYVSYPFLKKSFWKEAVDTSVNLERLDIIQVMLYLERLGSFTMADSFSCRIRHE

SEQ ID NO: 1024313 - protein, 170 aa, Homo sapiens
KYGTYCVVPYTRGEEVSRPSDDILFEIAQLAAQGVREVNLLGQNVNAWRGENYDGTTGSFADLLRLVAAIDGIDRIRFTTSHPIEFTDDIIEVYRDTPELVSFLHLPVQSGSDRILNLMGRTHTALEYKAIIRKLRAARPDIQISSDFIVGFPGEPRLRENVELFAAQFR

SEQ ID NO: 1024314 - protein, 175 aa, Homo sapiens
LALLIMVSKSSRGPGMAAAGSEAEEALLLPERVAGDAGAPPGNASVLGAVFNVSTSVVGAGIMSIPAAMRVLGVAPALALIVCVALLANVAVDFMLRYTRGTPSYAALMGGSFGRAGAKLLNVFIAFNCVGTLTVYLIIIGDVMSGPVGSGEAHAGVLPEWFGPHWWTGGTAVLV

SEQ ID NO: 1024315 - protein, 75 aa, Homo sapiens
RLGMTLGRQLLCLPVGAPPAPAMLSALARPASAALRRSFSTSAQVWPDEGLACMAGWPPVPWATVLSPVFCWCML

SEQ ID NO: 1024316 - protein, 284 aa, Homo sapiens
MTLGRQLLCLPVGAPPAPAMLSALARPASAALRRSFSTSAQNNAKVAVLGASGGIGQPLSLLLKNSPLVSRLTLYDIAHTPGVAADLSHIETKAAVKGYLGPEQLPDCPEKGWWMWVCNPGLESPKKPGFDPVDDLVSNTNCQQNLMDHHDTLPCAQHCPEATDSAIIANPVNSNIHITADSLSKKHGSVQTTNKIYQDVTTPGASVESQNFGLQAWNGFGSQVRVYLSLSLGWPCLGKNIIPLISQCTKVGPFPRTSDRLTGRIRRPDGGGQGKSGAGSVNLS

SEQ ID NO: 1024317 - protein, 73 aa, Homo sapiens
SRHLVPTSIPLDNGNHSFLHETATWWFVPPRPTHFPISWTATVSQIPNMSLAASSSLGLATDRDPLQPELRHW

SEQ ID NO: 1024318 - protein, 310 aa, Homo sapiens
MEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 1024319 - protein, 329 aa, Homo sapiens
AFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 1024320 - protein, 310 aa, Homo sapiens; identical to SEQ ID NO: 1024318

SEQ ID NO: 1024321 - protein, 121 aa, Homo sapiens
MWLLPQELKRLDARGGQERELLFPSAEGKKGLLSQRETESVAKDLSFPMSLSSSPFIFPYLSDRISETPYVTAVCVLVHKLVFSVVCVCECCKYAHTQGLTTPHLGLQTPVRPVSSYRVSP

SEQ ID NO: 1024322 - protein, 82 aa, Homo sapiens
MHVNWELVCRLAILPVTQDFSSSLHFLDLYRANGNPSYASQPLKIRFVNSITLQVIGLPSLNDVILIRQAGPFMQGMLVVYV

SEQ ID NO: 1024323 - protein, 191 aa, Homo sapiens
TSFIRKVPNSIMKLSNLTILNLQCNELESLPAGFVELKNLQLLDLSSNKFMHYPEVINYCTNLLQIDLSYNKIQSLPQSTKYLVKLAKMNLSHNKLNFIGDLSEMTNLRTLNLRYNRISSIKTNASNLQNLFLTDNRISNFEDTLPKLRALEIQENPITSISFKDFYPKNMTSLTLNKAQLSSIPENYSPN

SEQ ID NO: 1024324 - protein, 207 aa, Homo sapiens
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTATTSFQDFYTSRWWPPGQKREMGGLALRQVGPPPACCSLAGGCVAATVNPAQTTTPQYSLPLCCCRIR

SEQ ID NO: 1024325 - protein, 387 aa, Homo sapiens
PSRRRPPTKPQAGAGAAAARACGAEPLARAVGESVRPSVRPSGRRSSRQAQRPRPLVSPHPEPPGGAGLAAAAMSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVTVSWSANTIIRDFYNPVVPEAKSRENWARPGTWAGAGRALQLTVVRHCLLILFPTRDEVTGTRVAYFATGSPGREPLATGIRTAGNSFRGPDPWRHPPPPRQSRAQFTQPGNAATRAQHVNKSEQTATPSHSRSDSEITTDKLTDRSSEAARAEQLACECNTIRSPVGVRISRHESDNNSI

SEQ ID NO: 1024326 - protein, 37 aa, Homo sapiens
MPRPTGPWGLGLSNRIVCIRILGWNPFTNGFWFRMAP

SEQ ID NO: 1024327 - protein, 202 aa, Homo sapiens
PSRRRPPTKPQAGAGAAAARACGAEPLARAVGESVRPSVRPSGRRSSRQAQRPRPLVSPHPEPPGGAGLAAAAMSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAEARDGRGPV

SEQ ID NO: 1024328 - protein, 458 aa, Homo sapiens [sequence omitted]

SEQ ID NO: 1024329 - protein, 258 aa, Homo sapiens
MERKLTSPLKKAFIGCYMFIARDFDALNERIQKETTEQRALEEQEKQERAERVRKLREERKQNEQEQAELDGTSGLAELDPEPTNPFQPIASVIIENEGKLEREKKNQKMEKDSDGCHLKHKMEHEQIETQGQVNHNGQKNNEFGLVENYKEALTQQLKNEDETDRPSLESANGKKKTKKLRMKRNHRVEPLNIDDCAPESPTPPPPPPPVGWGTPKVTRLPKLEPLGETHHNDFYRKPLPPLAVPQRPNSDAHDVIS

SEQ ID NO: 1024330 - protein, 258 aa, Homo sapiens; identical to SEQ ID NO: 1024329

SEQ ID NO: 1024331 - protein, 258 aa, Homo sapiens; identical to SEQ ID NO: 1024329

SEQ ID NO: 1024332 - protein, 160 aa, Homo sapiens
WVKGAGLPRVTAGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCFVSFFDLRDPSQIDNNEPYMKIPCNDS

SEQ ID NO: 1024333 - protein, 75 aa, Homo sapiens
WVKGAGLPRVTAGMKPILLQGHERSITQIKYNREGDLLFTKNTKISQAWWHTPIVPATQEAEAGESLEPRRQRLQ

SEQ ID NO: 1024334 - protein, 105 aa, Homo sapiens
HEETSPSSIETKLNATSVINEEGQSKVTKEADIDDLSSHSQNLRASLVKAGDNISEAPYDKEKKILDVGNTLAAHKSNQKPSHSDEQFDQEDHIDAPRSNSSRKS

SEQ ID NO: 1024335 - protein, 143 aa, Homo sapiens
TIDDLEDEVYALKMKYKSRSEYTGNALKCHNFLLTPSQPCHLSSLLSSPFHSLYGEASRQKNKKLPTLHSQGWEQPRESPIMPTTHSGTGFILYLSPSTLLGCLINSETWEKTQTKQNKIIKANTNRKKQKHLWVWRARPRDP

SEQ ID NO: 1024336 - protein, 120 aa, Homo sapiens
EILILQTILKFALTNIWSCQSEPYSSFFRDFTSVTLRFSQVWSGKHLYRPVLRGVQFLSPTCNFLTPRPKIFLNSLLLTHTHSGPTSWIMYFPHHNYLLHYQILVQDQDDLLVFELSSSF

SEQ ID NO: 1024337 - protein, 39 aa, Homo sapiens
PGSMQCIHRELASDLVVAHHEMGHIQLVSCSYKDLPCGA

SEQ ID NO: 1024338 - protein, 48 aa, Homo sapiens
MAVAPTWCQVLRTSAGIIGMSHHTQDVTPFPDLSISQMGHCNSFPTGP

SEQ ID NO: 1024339 - protein, 90 aa, Homo sapiens
KPPTGTNPNSHRWPPPPSPVTVPRESHPTSETPGTFIIHPIPDSHPRIAREDFGLANCVGYVSVVLIRDVHDCQSAFLTSVTTLLRCNSS

SEQ ID NO: 1024340 - protein, 398 aa, Homo sapiens
MDIRKFFGAISSGKKPVNETVKKNEKTKPSEGTVKGKKGVKEAKVNNPCKEDASRPKQHNKKKRIIYDSDSESEETVQVKNAKKKSEKLPVSCKPGKISRKDPVTYISETDEDDDFLCKKAASKSKENGVSTNSYLGASNVKKNEENTKTKSKPLSPIKLTPTSVLDYFGTESVQRSGKKMVASKKKESSQTPDDSRLNDEAIAKQLQLDEDAELERQLHEDEEFARTLALLDEEPKTKKARKDSEEGESFSPAKAELSKAAKQKSPANEHFSIGRKTYSPAKYGKGRGSEGTKQPCRSAHQKEACSSLKASSKLALMKAQEENSYKETELLAAKRESAIEPKGEKTTPRKTKGSPTKRESVSPEDSEKNRTNYQSLSKLLKSRRSQSPGLQRNTQGS

SEQ ID NO: 1024341 - protein, 251 aa, Homo sapiens
GPDAPVPARTATTEGADRSDLNGHLCSSSPGYLCAARPQTMLLGRLTSAAVEGLFLGQAGVRLGPSLECWAAVVCGAPLQSHRRPAQVGGSLPRKGAQLELEEMLVPRKMSVSPLESWLTARCFLPRLDTGTAGTVAPPQSYQCPPSQIGEGAEQGDEGVADAPQIQCKNVLKIRRRKMNHHKYRKLVKKTRFLRRKVQEGRLRRKQIMFEKDLRRILAGVLVLEGRPPEWLAGPPMIYLVGNTEFLGGQP

SEQ ID NO: 1024342 - protein, 251 aa, Homo sapiens
VEVWAWEWVSGRPEVRRALRQAGPGSSREAPLGPVCRSATDHAPGAPDFPAVEGLFLGQAGVRLGPSLECWAAGSAGPFTAHRRPAQVGGSLPRKGAQLELEEMLVPRKMSVSPLESWLTARCFLPRLDTGTAGTVAPPQSYQCPPSQIGEGAEQGDEGVADAPQIQCKNVLKIRRRKMNPPQVPEAGEEDAVPAEEGPGGTPETQADQVRERPEAQSGWKAGAKGRPPEWLAGPPMIYLVGNTEFLGGQP

SEQ ID NO: 1024343 - protein, 667 aa, Homo sapiens
TASAGGGGDGGAAARGRAAARRRRRRRRRRRRRRRRRRRRRRRRRRRRRRLGLERPQPTSRGRAPGASRAEEKMEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQNTSSEGSRLRTGKDRNQKKEKPDSVDGQQPLVNGVP

SEQ ID NO: 1024344 - protein, 632 aa, Homo sapiens [sequence omitted]

SEQ ID NO: 1024345 - protein, 101 aa, Homo sapiens
MQRLCVYVLIFALALAAFSEASWKPRSQQPDAPLGTGANRDLELPWLEQQGPASHHRRQLGPQGPPHLVADPSKKQGPWLEEEEEAYGWMDFGRRSAEDEN

SEQ ID NO: 1024346 - protein, 267 aa, Homo sapiens
VGAALLPSPHPLKIVACSKFVSTPSLVKSTSQFAEPSSYLQVVLKRPEILTDESLSSLESHVPLPHLSLAESSKPAPFQGHRHRQPMFIGAGAATFGVAWSGAGIGTVFGSLIICYAREPFSEAQSSPTPFWALPSSEANGALLSDGSLSHPLVPCEEPSPPPIVLPRSGWPRCVLFLIPPQAAGGTGLCSVFDRRNGPINFWQKQETTKKVVGRRTPEKFNTIVCAGPINKNCQVSQEPRRVCWLPKKPGAVSPHGWPGYGVTPTQ

SEQ ID NO: 1024347 - protein, 204 aa, Homo sapiens
VPRCSLRPSRDGAPAYSGPSLLGLKAWASAGRAGRGRTAQEGPGSRETVPAASPAPTCGSPAPPADKRCGVSPRSASARSSSPAARSIPAQPPCPSTSAPRYSPRAQPPSRAAGPGAHELRRPGGLGSSSLYGLGASRRAWRAALPMGARWAGIREVTINQSLLARCGWTRPLPPAGAQEESEQIKTLNNKFAPSTRCGFLEQQ

SEQ ID NO: 1024348 - protein, 61 aa, Homo sapiens
LRRSRGSHYGRDHKHVLKLVAPSKPPWSGLMRPEGRVQDLDPAPLSRRFMIGRTEKSCGHL

SEQ ID NO: 1024349 - protein, 183 aa, Homo sapiens
GAAALAPGPAPAPPPRFSLSFGLSPPQRDAEPGAEPCARACRSDLDEREAFCESEFAVNGIVHDVDVLGAGIRLVTLLVDRDGLYKMNRLYLTPDGFFFRVHMLALDSSSCNKPCPEFKPGSRYIVMGHIYHKRRQLPTALLQVLRGRLRPGDGLLRSSSSYVKRFNRKREGQIQGAVHTQCI

SEQ ID NO: 1024350 - protein, 161 aa, Homo sapiens
GAAALAPGPAPAPPPRFSLSFGLSPPQRDAEPGAEPCARACRSDLDEREAFCESEFAVNGIVHDVDVLGAGIRLVTLLVDRDGLYKMNRLYLTPDGFFFRVHMLALDSSSCNKPCPEFKPGIETDLNDAAYVLYTTVCNVGATARAVGRPAFFWERWGTMT

SEQ ID NO: 1024351 - protein, 115 aa, Homo sapiens
MLFSKLFLEAAVNGIVHDVDVLGAGIRLVTLLVDRDGLYKMNRLYLTPDGFFFRVHMLALDSSSCNKPCPEFKPGIETDLNDAAYVLYTTVCNVGATARAVGRPAFFWERWGTMT

SEQ ID NO: 1024352 - protein, 183 aa, Homo sapiens; identical to SEQ ID NO: 1024349

SEQ ID NO: 1024353 - protein, 115 aa, Homo sapiens; identical to SEQ ID NO: 1024351

SEQ ID NO: 1024354 - protein, 137 aa, Homo sapiens
MLFSKLFLEAAVNGIVHDVDVLGAGIRLVTLLVDRDGLYKMNRLYLTPDGFFFRVHMLALDSSSCNKPCPEFKPGSRYIVMGHIYHKRRQLPTALLQVLRGRLRPGDGLLRSSSSYVKRFNRKREGQIQGAVHTQCI

SEQ ID NO: 1024355 - protein, 347 aa, Homo sapiens
CPLLGGKGFVTKQTTKHVHHHYIHHHAVPKTKEEIEAEATQRVHCFCPGGSEYYCYSKCKSHSKAPETMPSEQFGGSRGSTLPKRNGKGTEPGLALPAREGGAPGGAGALQLPREEGDRSQDVWQWMLESERQSKPKPHSAQSTKKAYPLESARSSPGERASRHHLWGGNSGHPRTSPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 1024356 - protein, 347 aa, Homo sapiens; identical to SEQ ID NO: 1024355

SEQ ID NO: 1024357 - protein, 282 aa, Homo sapiens
CPLLGGKGFVTKQTTKHVHHHYIHHHAVPKTKEEIEAEATQRVHCFCPGGSEYYCYSKCKSHSKAPETMPSEQFGAQSTKKAYPLESARSSPGERASRHHLWGGNSGHPRTSPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 1024358 - protein, 255 aa, Homo sapiens
HEVCFNCTLRVDQTIHVKCFECPLRICILCFQCGAESPPHRRGHNYELVKPTSNPEAMSWTHEDEFELLKAAHKFKMGNWGEIAESIGRGRKDGHNCKDYFEKHFVRGWIGQFSIKSSSWDRIKYGMYINQTLDSVLQKNCLESTERMLLIRDAVRASGESWDENDPKLAIKVQQVLEQYVQKVIDDDIETKYERPKFLTNQYETELSPDDCDPDNERDMKSKRSVKQEINTDDSDNDNSPGPSSSCRKKGPPSP

SEQ ID NO: 1024359 - protein, 205 aa, Homo sapiens
REDGGAAVLVAVKRVIDYAVKIPVKPDMDLVWSLDGVMHSMNPFLEICVWSECLVLAQWRRSLVKEVICRQLWACTVAMETIRTALAMGAGPDGVHVDGAPSRSMNCLGPLQVCSGPGQAWQRMEKVDLVLLGKQAIDDDCNQTGQMTAVDFLTCATGHIRLPVCCLEWGQVKVEREIDWGLETLRLKLPAVVTAELRLKEPRYA

SEQ ID NO: 1024360 - protein, 529 aa, Homo sapiens
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 1024361 - protein, 43 aa, Homo sapiens
MRANWSWTSQPPEPPHCLLKVAFRNGAVLCPHLRSAALLRDLR

SEQ ID NO: 1024362 - protein, 123 aa, Homo sapiens
MKGHALNDVTAVVEHTADVLSVHSAGEKRVAVVTPISTGSADPQKLISNEVLGPGHAWVLSGLGSCILRSCASKFWKVVLNLRFPSKDFLSEQLLVEEDHRGAHSVVPEALEEVQSLLQVGLV

SEQ ID NO: 1024363 - protein, 81 aa, Homo sapiens
QEAHTDLERVRAIWIWICHHIEYDIAAAQEKDRQAFKPTDILRTQKTNCDGYAGLFEENVQVALSRGQASVGSMSRGPQRR

SEQ ID NO: 1024364 - protein, 166 aa, Homo sapiens
RFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKEGSSVEGTGNWGLLRNLSLLKGMTTKLFGQETPEQREARIKVLEEQ

SEQ ID NO: 1024365 - protein, 304 aa, Homo sapiens
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPNAPRTRKKRCPYSKFQIRELEREFFFNVYINKEKRLQLSRMLNLTDRQVKIWFQNRRMKEKKLSRDRLQYFSGNPLL

SEQ ID NO: 1024366 - protein, 174 aa, Homo sapiens
MVPDEQIGVISSTSHITKATLITKNLKKVQHSSAHLERMKIEPGTDAEATSSIVWMTAEQLALKGGKKQIPETGGQGSGDWKEKLKVSKKPYAEAVKGLRKHERRVKELTYQTEEDRKNILRLQDLVRECVSGGDLLVGESALGCDRSNTNLAKFRKLQHELEEAEERAALLNP

SEQ ID NO: 1024367 - protein, 174 aa, Homo sapiens
MVPDEQIGVISSTSHITKATLITKNLKKVQHSSAHLERMKIEPGTDAEATSSIVWMTAEQLALKGGKKQIPETGGQGSGDWKEKLKVSKKPYAEAVKGLRKHERRVKELTYQTEEDRKNILRLQDLVDNFRQSEILYRGQPEEAEEQSNTNLAKFRKLQHELEEAEERAALLNP

SEQ ID NO: 1024368 - protein, 227 aa, Homo sapiens
MPGEVDLDQDRCQRAEMGQRCGCLPATGAMPSRARLRSCSSSQNAPGRNVRKALVSGPDLLPQDWLLRPSALSGRTARGSSRTWGSILQNSSWLFQDLGLHLAEQLVALPGPGAPSCRTARGSSRTWGSILLRGAFLRLLRDDSDFPWGCAMAVIFQGPLGLGSEVATFPGAREGGLDASWAACLWRGRNEELVRLGPLGAWSCSHDAPLKPDMGAEDSPAGSRFTD

SEQ ID NO: 1024369 - protein, 286 aa, Homo sapiens
MPGEVDLDQDRCQRAEMGQRCGCLPATGAMPSRARLRSCSSSQNAPGRNVRKALVSGPDLLPQDWLLRPSALSGRTARGSSRTWGSILQNSSWLFQDLGLHLAEQLVALPGPGAPSCRTARGSSRTWGSILLEQSWLFQDLGLHLAEQLVALPGPGGSILQNSSWLFQDLGLQSSEPVVALPGAEGSILLKGCFLETALGTIPDFPWGCAMAVIFQGPLGLGSEVATFPGAREGGLDASWAACLWRGRNEELVRLGPLGAWSCSHDAPLKPDMGAEDSPAGSRFTD

SEQ ID NO: 1024370 - protein, 135 aa, Homo sapiens
PTAKTGILRSLIIFSLVYRYSIKKAGPGKNNSNQGKGENQQFSEKDALSGGKGHHGKSVIVNLKKHHCIEGPASMGGAWIGRKFSRIGFFVDQHVTCEIGVFSIFIEVLGRGVLISNVASDPYHHNAFLLHHGFR

SEQ ID NO: 1024371 - protein, 92 aa, Homo sapiens
LAESDTSREGKVKFPEWLCVWGFIHPTWKWTYWKKGERMEKVEHSDWSFSKDGSFYLWYYTEFTPTEKDEYAGRVNQVTWSQPKIVKWDRDV

SEQ ID NO: 1024372 - protein, 71 aa, Homo sapiens
TRVSEALLLSARQEDVCRRRSAGPVAFTVLSSAGQAAAHGRHSSLQPQWHVEVVSTGLACNCVGLSALQPT

SEQ ID NO: 1024373 - protein, 78 aa, Homo sapiens
VPPPRAWAGRLGPARGAAAVLRALLALPTDIMLQFLLGFTLGNVVGMYLAQNYDIPNLAKKLEEIKKDLDAKKKPPSA

SEQ ID NO: 1024374 - protein, 78 aa, Homo sapiens
TAPRCQAQGTGPARLQRPRTHDELQLKAGDVVLVIPFQSPEEQDEGWLMGMKESDWNQHKELEKCRGVFPENFTERVP

SEQ ID NO: 1024375 - protein, 128 aa, Homo sapiens
KSTTLAREYFAKMRGAIMTERTPEEPSERYRQISCDGRDELPVDGDILRHRADQRQQIFCTSMSKCARRSGDDDRRMQVGSGFYHLHRFEIVNIECRNRITAALCVVQHLLCRYVHFHILSFVFDFKI

SEQ ID NO: 1024376 - protein, 85 aa, Homo sapiens
RRGSLSPARRAHQSFQRRFPATAFRASLRSQHGKFQKHAGKDGYNYTLSKTEFLSFMNTELAAFTKNQKDPGVLDRMMKETGHQQ

SEQ ID NO: 1024377 - protein, 88 aa, Homo sapiens
TPALCAARAPGFSISSTMSEFSSPPETERCIESLIAVFQKYAGKDGYNYTLSKTEFLSFMNTELAAFTKNQKDPGVLDRMMKETGHQQ

SEQ ID NO: 1024378 - protein, 102 aa, Homo sapiens
GEAPTAPHAARTRAFSAAPSHSLPRLAQVPTWPKFSSPPETERCIESLIAVFQKYAGKDGYNYTLSKTEFLSFMNTELAAFTKNQKDPGVLDRMMKETGHQQ

SEQ ID NO: 1024379 - protein, 115 aa, Homo sapiens
ILARCNLCLLGLSGSPASASRVAGITGVHHHAEPIFVFLVETGFPHVGQTGFKLLTSGDLPALASQSAGITGMSHCAQPQVTLVSLGLPTLKFWDCFCQATGVASSDGSFLFFLG

SEQ ID NO: 1024380 - protein, 184 aa, Homo sapiens
RHEEIFIANEGVHTGQFIYAGKKASLNVGNVLPLGSVPEGTIVSNVEEKPGDRGALARASGNYVIIIGHNPDENKTRVRLPSGAKKVISSDARGVIGVIAGGGRVDKPLLKAGHAFHKYRLKRNFWPKTRGVAMNPVDHPHGGGNHQHIGKASTISRGAVSGQKAGLIAARRTGLLRGSQKTQD

SEQ ID NO: 1024381 - protein, 38 aa, Homo sapiens
MDHACLSSALCVWAKTKDQGIASQRAYGSIDDGTHVRY

SEQ ID NO: 1024382 - protein, 345 aa, Homo sapiens
ARATISSLPSTWYDASSTSQTSVSYASQESDYAVNQNSWSASTNQLPSTSTTSYYAPTFSTSADFAASNVNAASDVSTASVPIDTSANSIPFTTTSNIETTTSAPLTSDTPLISTSTMSAADNVFSSANPISASLTTTDSSESFDQTSTAGAIPVQSSADFSSSSEILVQSSADFSSPSSPTTTDISLSAAPLQTSESSSFTTASAALPVSSTDVDGSSASPVVSMSAAGQIASSSSTDNPTMSETFSLTSTEVDGSDVSSTVSALLSAPFLQTSTSNSFSIVSPSVSFVPSQSSSDVASSSTANVVSSSFSDIPPQTSTSGSVVSVAQSASALAFQSSTEVYGA

SEQ ID NO: 1024383 - protein, 220 aa, Homo sapiens
IRFFENDTERYENVEMKFSVKSCKSVDECKLHKGGYNGLNQCLPTMQSKMFQCDKYVKVFNKFSHSDRHKIKHMENKPFKCKECGRSFCMLSHLTRHERNYTKVNFCKCEECEKAVNQSSKLTKHKRIYTCEKLYKCQECDRTFNQFSNLTEYKKDYAREKPYKCEECGKAFNQSSHLTTHKIIHTGEKPYKCEECGKAFNQFSNLITHKKIHTEVSRSD

SEQ ID NO: 1024384 - protein, 118 aa, Homo sapiens
RSTDLTTHKIVHTGEKPYKCEECGKAFNQSSHLTTHKIIHTGEKPYKCEECGKAFNRSSNLTKHKIIHTGEKPYKCEECGKAFNRSSTLTRHKIIHTGEKPYKCEECGKAFKLVLNSY

SEQ ID NO: 1024385 - protein, 88 aa, Homo sapiens
WDHPGNPGVWLGSSVASVPPVGDLRSEWEGQSPPKRWKRTGLGWKRLRGAIFPGCLFALCDHRAYTSESGTNSQITDPLSLLLMSSNG

SEQ ID NO: 1024386 - protein, 136 aa, Homo sapiens
AVYCWKLVHCARQARDAPTGTMRNCGQIFQEGVMQNISLPQYRAGCLVGTGPPPSSHTCSEAEKRAGQGRASLQPLGTNPCGRQTKAPRGLWKPGAEGQAMFGDSDCTGTFSMTWRGWDRGSCDPWSSGRGLQGQP

SEQ ID NO: 1024387 - protein, 100 aa, Homo sapiens
EPRGALLTVLPAQPSLEAAGPAEPPKPGGGNWLMAPRRSVLLGRQAQSPAATPTSYGVFCKGLSRTLLAFFELAWQLRMNFPYFYVAGSVILNIRLQVHI

SEQ ID NO: 1024388 - protein, 69 aa, Homo sapiens
SNVKAGAFLSHVPLGPGAKCWRTSYGVFCKGLSRTLLAFFELAWQLRMNFPYFYVAGSVILNIRLQVHI

SEQ ID NO: 1024389 - protein, 64 aa, Homo sapiens
HFKTLMIIYLSKEKWHSEEVAPCLLAQPPAILTPPGQAGTTADHSAMFQCMAHICQSWDLTQAA

SEQ ID NO: 1024390 - protein, 145 aa, Homo sapiens
GDAGGERRSRQDYFYRGSTFVVSLIFSRDMNEAKRRVRELYRAWYREVPNTVHQFQLDITVKMGPGSQSETQMFMTEMPMSQTPQGGLIFWSLKGTQNRHWKKTIKGIGKQRDHIVYAVLPSEHQKGAKGQKGLSLSKFYVGHDP

SEQ ID NO: 1024391 - protein, 162 aa, Homo sapiens
GDYGGERRSRQDYFYRGSTFVVSLIFSRDMNEAKRRVREIYRAWYREVPNTVHQFQLDITVKMGPGSQSETQMFMTEMPMSQTPQGGLIFLSLKGKRIDPERKQLKVLESQRDHIVMRFFPVNTRKGAKGQKGLSLSKVSYCLGQRIHDKSIHVEHGCTVDT

SEQ ID NO: 1024392 - protein, 72 aa, Homo sapiens
AVKAAISPGDSKCRIRSARGDVVLYSHVFGCWQRLGDGTAQSRGPFGAAISPYVFNGGTILAIAGEDLQCCF

SEQ ID NO: 1024393 - protein, 81 aa, Homo sapiens
ETAIDVEKKEPGKASETKQGTVKIAAQAAAKKDEKKEDSKKTKKPAEENNPREKEKKEKHVEPAKSPKKEHSVPSDKQVKA

SEQ ID NO: 1024394 - protein, 300 aa, Homo sapiens
RLYRSRVVWMRVQEQTGGSQARTMAALQEKKTCGQRMEEFQRYCWNPDTGQMLGRTLSRWVWISLYYVAFYVVMTGLFALCLYVLMQTVDPYTPDYQDQLRSPGVTLRPDVYGEKGLEIVYNVSDNRTWADLTQTLHAFLAGYSPAAQEDSINCTSEQYFFQESFRAPNHTKFSCKFTADMLQNCSGLADPNFGFEEGKPCFIIKMNRIVKFLPSNGSAPEWTAPSWTSPASSAAAAGQVLPSQRHLQSALLPLLREESPAPYKKPPLVASEGSSRFPGTAEGSPSVLQRSWQKPLTSKN

SEQ ID NO: 1024395 - protein, 107 aa, Homo sapiens
RLYRSRVVWMRVQEQTGGSQARTMAALQEKKTCGQRMEEFQRYCWNPDTGQMLGRTLSRWGKAEGPQSILKAELTWSPSCRTPVEGVHRLAPNVSRMSENSILKVCF

SEQ ID NO: 1024396 - protein, 105 aa, Homo sapiens
TQINTHTHTTSRTLKKMETPLDLLKLNLDERVYIKLREARTLVGTLQAFDSHCNIVLSDAVETIYQLNNEELSESERRCEMVFIRGDTVTLISTPSEDDDGAVEI

SEQ ID NO: 1024397 - protein, 115 aa, Homo sapiens
MASKRALVILAKGAEEMETVIPVDVMRRAGIKVTVAGLGWKRPSTVYRDVVICPDAILEDAKKEGPYDVVVLPGGNPGAQNLSESAAVKDILKEQENRKGLKSPICAGPYCSVGS

SEQ ID NO: 1024398 - protein, 115 aa, Homo sapiens; identical to SEQ ID NO: 1024397

SEQ ID NO: 1024399 - protein, 227 aa, Homo sapiens
KDFDSPENGADSFQSSDSLLQSWNSQSSLLDVQRVPSFESLEDDSAEPELYALNKPTMYFKDYIQERSDPVEQGKPVIPAAVLGRLHRKWTYSAVAVSPGAAITQILPVIHQLDWRLMEFKLADPDEVAASGERGLAHDELREAEPGLTLLLRLEHHAQDVGESATCSRLNVRTSETCLGFQRPEGTVTRITWAVTTPYTGRYLTFRPGTHPLNPAPQGFVVPVGCP

SEQ ID NO: 1024400 - protein, 100 aa, Homo sapiens
ELTPMGCRLPSIGGDGLLSGKEETRKIPVPANRYTPWKENGMKIFTPDGGTFGDFSIRFNCEIKGMYQIRHWIRKPSDVTCSDTKQRDLVKAFQSSAFQR

SEQ ID NO: 1024401 - protein, 237 aa, Homo sapiens
MEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 1024402 - protein, 323 aa, Homo sapiens
SGLVWKAERKPRLRWLENPRLFSGRLSHSRDNRQKPRNHLPRCEPDAETRFAPSGCKGQLQPGTAAPRTPPSRGRSRTPVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 1024403 - protein, 395 aa, Homo sapiens
GASEDGWADDGGRGSVPPLQLPSFRPLPAKGRLRAETTDRNPETTCHDVNLMQKRGSLPRDAKANFSLARRRRGLHHPGEGAGPLWVTWDCGAGVSPAGLELSSEEALGCRTGVREPGVSCVLCGHLGEEGAAPSCPGLWICPAVGGVGAAVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 1024404 - protein, 603 aa, Homo sapiens
MAVARKIRTLLTVNILVFVGIVLFSVYCRLQGRSQELVRIVSGDRRVRSRHAKVGTLGDREAILQRLDHLEEVVYNQLNGLAKPIGLVEGPGGLGQGGLAATLRDDGQEAEGKYEEYGYNAQLSDRISLDRSIPDYRPRKCRQMSYAQDLPQVSVVFIFVNEALSVILRSVHSVVNHTPSQLLKEVILVDDNSDNVELKFNLDQYVNKRYPGLVKIVRNSRREGLIRARLQGWKAATAPVVGFFDAHVEFNTGWAEPALSRIREDRRRIVLPAIDNIKYSTFEVQQYANAAHGYNWGLRCMYIIPPQDWLDRGDESAPIRTPAMIGCSFVVDREYFGDIGLLDPGMEVYGGENVELGMRVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 1024405 - protein, 76 aa, Homo sapiens
LLCTCMVACVCGGSVSAGRKRCSWCVGLYALAVRDPSGYRLESFLGLRLVQGLGAGGVSVMARVLVRDSFSGALFG

SEQ ID NO: 1024406 - protein, 183 aa, Homo sapiens
MAQSVINARQSEQLPLTIADIVLRFYDACDTLSAPDVTFDPELVVPVVAAGAVVYRVPGIVFILQSQHIQEILEMNPDPAMELQKMLPHGGIVVLVQTSGQDPSGLFIPGNPGGQSWMERSRPLQSLLSCMRKAGITTHEEHLRGLHQCLWDTLSCATATGSILPSGLCLQEHGSVRGSAGDA

SEQ ID NO: 1024407 - protein, 138 aa, Homo sapiens
AHSSYLRSQSQHLISQEAITDPHDAEELKKEQDTSAHLERMKKNMEQTIKDLQHRLDEAEQIALKGPRSSCRSWKPGAELENELEAEQKRNAESVKGMRKSERRIKELTYQTEEDRKNLLRLQDLVDKLQLKGQGLTK

SEQ ID NO: 1024408 - protein, 355 aa, Homo sapiens
TSTPSPLISSHVAANAQAVPLQNNNRNTSNGDNGSNVNHDNNNGSTNTPQLSLTPYANNSAPNGKFDSVPVDASSIEFETMSCCFKGGRTTSWVREDGSFKSIDRSLLDRFIAAYFKHNHRLFPMIDKIAFLNDAATITDFERLYDNKNYPDSFVFKVYMIMAIGCTTLQRAGMVSQDEECLSEHLAFLAMKKFRSVIIFQDIETVRCLLLLGIYSFFEPKGSSSWTISGIIMRLTIGLGLNRELTAKKLKSMSALEAEARYRVFWSAYCFERLVCTSLGRISGIDDEDITVPLPRALYVDERDDLEMTKLMISLRKMGGRIYKQVHSVSAGRQKLTIEQKQEIISGLRKELDEI

SEQ ID NO: 1024409 - protein, 237 aa, Homo sapiens
MVNFSSNQKRSPSHQWHASWRYAPLTALCTSNMDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCHLQ

SEQ ID NO: 1024410 - protein, 966 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPWGILCTALRSHSQAWSEVLKASLGFEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMARLFEMGFCDRQLNLRLLKKHNYNILQVVTELLQLNNNDWYSQRY

SEQ ID NO: 1024411 - protein, 937 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQGLWGLLSFLHLAKKCFFLKAPSEAFSWF

SEQ ID NO: 1024412 - protein, 957 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGRRKKKFFFFFPPFWGVWEKPEGGPSVTGS

SEQ ID NO: 1024413 - protein, 310 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRANNF

SEQ ID NO: 1024414 - protein, 966 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 1024415 - protein, 836 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGALLVYIIMVPQEWIYQLPYQKFLQSLIRSEEAPSWEQHCWRTGEGGFVCCCLCIQGPVCWATSHCTANNF

SEQ ID NO: 1024416 - protein, 966 aa, Homo sapiens; identical to SEQ ID NO: 1024414

SEQ ID NO: 1024417 - protein, 111 aa, Homo sapiens
CPWVSVPLNLKKREGPTAVNCNTAAVNCNTAALPLSGSLPPAPPAPGALACPWASALLATCLHLGWGWGDQLSTQILASAPSARADFRTICNDETPRFPLSLGKAFFVLGN

SEQ ID NO: 1024418 - protein, 236 aa, Homo sapiens
GFLLWLSRNPSVSSGIHDFSAVILGKEWANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIDTDTDETTAKKQQSIAGSADSKPIDVSRLGSSNRLHHNYSDIHLMQILACAAVDVGEIAQDSATGLGSRSLERMKTDGLHWN

SEQ ID NO: 1024419 - protein, 342 aa, Homo sapiens
SQSAEIAASAPGGQPGTSEVMDASSAMDRAIDRGNGDGSPIWPGRAEIWEVRMQLFPGVILSRKLRSVSDPGRAIIWDVGMHLLHSVWPLLMDVKSAFCAGASTHVVGTEECLVAPPRIPSREGFFCRHLGQKWANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIDTDTDETTAKKQQSIAGSADSKPIDVSRLGSSNRLHHNYYDIHLMQILACAAVDVGEIAQDSATGLGSRSLERMKTDGLHWN

SEQ ID NO: 1024420 - protein, 256 aa, Homo sapiens
GASAASAGAGRGPRSHSLLFLGEAPECPGLEAMRRQWGSAMRAAEQCGLHGERLPGLDSPEAGPCGAAGWGNPEPVALGLVLLPRGHLRPLPASWQLKSWALAGRRLPAMADSCMWTDLLPCTVACVGPNWARVPGGLLLELVCLPMWLCTAPVRHASEPWPILPLSLLGCPRAAPGFLSELLLHAELAWLLGPTFARLFAGLMACGTCGCFSMRWLLGLTEVSDVTRMVDQLRAAGDGLALLGSAARPRRSVGCE

SEQ ID NO: 1024421 - protein, 550 aa, Homo sapiens; identical to SEQ ID NO: 842530

SEQ ID NO: 1024422 - protein, 141 aa, Homo sapiens
VLPRALQSCLRAVPVASPDVRSGVLLWVQSSGRSSGHTGDLGGLPMTVLLASAQRQIALVPVLPGTGMRQHQCPPHSAAVGGRTLEPGAAPGVLATGHQSHLAGVGQVVVAVATVTPLSLIMPHHDHAGSLQTGSRCRASR

SEQ ID NO: 1024423 - protein, 95 aa, Homo sapiens
KKATPGSLAPKTVRYGWGLAVLWTGQEAPWALDTARSSANCISGPGQALYLIAQWCLSPHLGNKANRICTKLSASRTLEGLNKIRDLIPRWNEEW

SEQ ID NO: 1024424 - protein, 57 aa, Homo sapiens
RGNKNLTVLPDEAETCTAKLTDPRLLYIGFLGYCSGLIDNLIRRSQTVTAGLHRQLL

SEQ ID NO: 1024425 - protein, 39 aa, Homo sapiens
NSVTAADTALYYCAREVRDNYIDHGIDVWGQGTMVTVSS

SEQ ID NO: 1024426 - protein, 40 aa, Homo sapiens
EDTAVYYCTTDLGGAYCTRGVCYYETFKYWGQGVLVTVSP

SEQ ID NO: 1024427 - protein, 141 aa, Homo sapiens
PAEHKRRLLQEAERNDLGRRGKASPQQKICLLTKSSSKIAPFLTSGFKITSHDKQPERADCESQMRQLGHRSAGGVSWVITKLHTSTMGPSKTVDPNKHIPVPLGALREAKSRLRGACNPKKMSGSRPRDPRRKVSQSSTD

SEQ ID NO: 1024428 - protein, 181 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIER

SEQ ID NO: 1024429 - protein, 395 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKEEEEWFESFIESWAPLLKSLEDVRTEVKMVDCDSERRSIRMESRIITQGEKADSFYIIESGEVSILIRSKTKSNQGWGTRRSRCPLHKGQYLESLPWSQQNQSAQLMRWDVKCQYGGTTMRGSGPDGIEKESNKRKRRNMGPRLNPAP

SEQ ID NO: 1024430 - protein, 60 aa, Homo sapiens
AAAYYYYYCSEFKLLTMYGDMSCPIPILPDPCDLPQIPSSQTAPGRGGAGVGARTPQSPP

SEQ ID NO: 1024431 - protein, 112 aa, Homo sapiens
MCPIDFRGGKQTPFGNLPGTQPPSEPTLAQPPFPGRGPASFAPARVQPVRKPRVCLVVSFRSPESGVRDAPSAHTRRTSRSDAACSRCDRVLPWADPKEAFWLSATSSCWTA

SEQ ID NO: 1024432 - protein, 198 aa, Homo sapiens
EAGLEALGLPSGVLQTPASDMAPGLRNMRSAKIAKSARASSILMSWLYLARRYERQGAPVLICPVQSPTTRSAMNVSSVSPERWVHHHPPAIRLSQFARLDRFGHRADLVDLQQQTVAGLLLNGLGNPSWELVTCQGHTPDNLVCSRPVEGSEVQCGHSHPGISLIESSYYSSARFSHSDVPSRDHGDLVTDRTSHMR

SEQ ID NO: 1024433 - protein, 220 aa, Homo sapiens
QTQPRFPWTCHKTKEDSCAEGAGSAASWLCQDHTYQGRTRMSDTEEQEYEEEQPEEEAAEEEEEEEERPKPSRPVVPPLIPPKIPEGERVDFDDIHRKRMEKDLLELQTLIDVHFEQRKKEDEELVALKERIERRRSERAEQQRFRTEKERERQAKLAEEKMRKEEEEAKKRAEDDAKKRRCCPTWGAILAATWSRQNRSVVSGSGPGDEGAHRSERKKL

SEQ ID NO: 1024434 - protein, 191 aa, Homo sapiens
MSDTEEQEYEEEQPEEEAAEEEEEAPEEPEPVAEPEEERPKPSRPVVPPLIPPKIPEGERVDFDDIHRKRMEKDLLELQTLIDVHFEQRKKEDEELVALKERIERRRSERAEQQRFRTEKERERQAKLAEEKMRKEEEEAKKRAEDDAKKRRCCPTWGAILAATWSRQNRSVVSGSGPGDEGAHRSERKKL

SEQ ID NO: 1024435 - protein, 224 aa, Homo sapiens
AGIRHEGKSKMSLKEIVDHLEKLYCSSYGVQYTHIPSKQKCDWLRERIEIPEPYQYTVDQKRQILDRLTWATSFESFLSTKFPNDKRFGLEGLESVVPGIKTLVDRSVELGVEDIVLGMAHRGRLNVLSNVVRKPNESIFSEFKGSSARDDIEGSGDVKYHLGMNYQRPTTSGKYVNLSLVANPSHLESQDPVVLGRTRALLHAKNDLKEKTKALGVLLHGDAA

SEQ ID NO: 1024436 - protein, 50 aa, Homo sapiens
GREMKVRILSERKKPLDIDYMGEEQLREKAQELSDWIHQLESEKFDLMAN

SEQ ID NO: 1024437 - protein, 162 aa, Homo sapiens
APGLETVVCGTPKPLSFHSAFCLVITFPWRRAQPWWKSPALALSLGMRWQRMVLLGDPHVCTLGAACLLHSSFKYLSSSCVPAAGLQDGSVLGDHAVAEEAGCSPHATTSPLPVHTNKVLLEYSHTHFSAYCLWLLSCYNRELNSWDRDLWPAKLNYLPSGS

SEQ ID NO: 1024438 - protein, 79 aa, Homo sapiens
RLSMLHFLILYVGPLPLIFQITPLTVTQWLMVLKISLPVILMDETLKFVARNYLEPAILEYPLPKPFLQKCKGVRVACM

SEQ ID NO: 1024439 - protein, 46 aa, Homo sapiens
VWWNSKLKEAETRAEFAERSVAKLEKTIDDLEDEVYAQKMKYKAIS

SEQ ID NO: 1024440 - protein, 142 aa, Homo sapiens
MMWPMHTPLLLLTALMVAVAGSASAQSRTLAGGIHATDLNDKSVQRALDFAISEYNKVINKDEYYSRPLQVMAAYQQIVGGVNYYFNVKFGRTTCTKSQPNLDNCPFNDQPKLKEEEFCSFQINEVPWEDKISILNYKCRKV

SEQ ID NO: 1024441 - protein, 229 aa, Homo sapiens
RAEHGGVQVEVLRLSDRYGIGVRARKAGASWLRAARPWGLSGPRDAGRYEEGQCSSTAGKSEPTITWNKGVRDSLDMEAKSPLCRGQMHFPRREMGGRQNLNPPVEPAGLKGTHKGFHNLFRPPSSREAFPAVPKTDEGPGNILITSGVAAFPRGCVKRQGAFLVQTKDPKLNRRASQEEKLLNAVWIDPRGTRLRRTKRRKWFLEVCSLTAGVFGKDQWRKIPKKEET

SEQ ID NO: 1024442 - protein, 54 aa, Homo sapiens
IDKFEFVEKLKRQKYDITTLRSRIDQAQKHSKKAGTPAKGKVGGRWERGQKGPS

SEQ ID NO: 1024443 - protein, 87 aa, Homo sapiens
GLRTVVVLPLVVRAAGARVADGGGGAGRTGVTVGRRAAAGFRIGDGRRAAVALGGARVVPPPVSDADLPVEVVEPLTLVELLLLDEV

SEQ ID NO: 1024444 - protein, 110 aa, Homo sapiens
HEIIMLPQHVKFILLSATVPNTYEFANWIGRTKQKNIYVISTPKRPVPLEINIWAKKELIPVINQNSEFLEANFRKHKEILNGESAKGAPSKTDNGRGGSTARGGRGGSN

SEQ ID NO: 1024445 - protein, 113 aa, Homo sapiens
PTKEELDAIIEEEDEDGSGTIDFEEFLVMMVRQMKEDAKGKSEEELAECFRIFDRNADGYIDPEELAEIFRASGEHVTYEEIESLMKDATEHTPLDFDESEMRGVRRRDSALP

SEQ ID NO: 1024446 - protein, 138 aa, Homo sapiens [sequence omitted]

SEQ ID NO: 1024447 - protein, 73 aa, Homo sapiens
DSKSQVRYLPSADLAFFLTPNTHSPPGTCVGRFELSPWTPNTHSPPGSSRLQMTCLLSVPGLRSDTCRIVNPK

SEQ ID NO: 1024448 - protein, 220 aa, Homo sapiens
MGNRAVYQHVTAFSGLDCGQASRGGDRDRDGCTWWTGLVMLWPSCGPGDSSSCRVLLSVFIYNPALLAAGQERLSESYNGKTCKDGKPVIDYHEEELLDEVYSSVLQQCYRHVQEVSGDPELQPVLAGLFLSMCLVTVLGNLLIILAISPDSHLHTPMYFFLSNLSLPDIGFTSTTVPKMIVDIQSHSRVISYAGCLTQMSLFAIFGGMEERHAPECDGL

SEQ ID NO: 1024449 - protein, 132 aa, Homo sapiens
ITILKWKPPSLNSVDFRLKITRMGGEGTSEDPERQLVLAGLFLSMCLVTVLGNLLIILAISPDSHLHTPMYFFLSNLSLPDIGFTSTTVPKMIVDIQSHSRVISYAGCLTQMSLFAIFGGMEERHAPECDGL

SEQ ID NO: 1024450 - protein, 138 aa, Homo sapiens [sequence omitted]

SEQ ID NO: 1024451 - protein, 144 aa, Homo sapiens
MPGVGLLVSHFSTLVSRQRCPNYADPQNLTDVSIFLLLEVSGDPELQPVLAGLFLSMCLVTVLGNLLIILAISPDSHLHTPMYFFLSNLSLPDIGFTSTTVPKMIVDIQSHSRVISYAGCLTQMSLFAIFGGMEERHAPECDGL

SEQ ID NO: 1024452 - protein, 120 aa, Homo sapiens
SYIPFPVKPKGIPKFYTSQTILQPVAAGLFLSMCLVTVLGNLLIILAISPDSHLHTPMYFFLSNLSLPDIGFTSTTVPKMIVDIQSHSRVISYAGCLTQMSLFAIFGGMEERHAPECDGL

SEQ ID NO: 1024453 - protein, 138 aa, Homo sapiens [sequence omitted]

SEQ ID NO: 1024454 - protein, 138 aa, Homo sapiens [sequence omitted]

SEQ ID NO: 1024455 - protein, 212 aa, Homo sapiens
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 1024456 - protein, 142 aa, Homo sapiens
MLPKASKLSMRTSACSLRTPSALPQRSRWGSYGSDPRLPTGDASPCSPPRGGRLAEGPVPSGVQTPQLQELFPGSRDLQAASSAPELGCTGDPRGGDLGSVDMSRAMEQSPALSPVLMALCCIFLLKFSDNSEQFHCDHCKW

SEQ ID NO: 1024457 - protein, 222 aa, Homo sapiens
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKVRIPELHTRKRGEVAQDDTVVAGTARCHAKAAAVSVCSSQMCEPGE

SEQ ID NO: 1024458 - protein, 185 aa, Homo sapiens
MAARRGALIVLEGVDRAGKSTQSRKLVEALCAAGHRAELLRFPERSTEIGKLLSSYLQKKSDVEDHSVHLLFSANRWEQVGRQSLILSPRLECSGTISAHCNLCLLSSSDYPASVSRVSGIIGMHHRAQLIFILLVETGFYHVGQAGLKLLTSSDPLISASQSARITGMSHCTQPPDAFSKMVHL

SEQ ID NO: 1024459 - protein, 142 aa, Homo sapiens; identical to SEQ ID NO: 1024456

SEQ ID NO: 1024460 - protein, 212 aa, Homo sapiens; identical to SEQ ID NO: 1024455

SEQ ID NO: 1024461 - protein, 193 aa, Homo sapiens
MAARRGALIVLEGVDRAGKSTQSRKLVEALCAAGHRAELLRFPERSTEIGKLLSSYLQKKSDVEDHSVHLLFSANRWEQVRFPLHSTLNVENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 1024462 - protein, 212 aa, Homo sapiens; identical to SEQ ID NO: 1024455

SEQ ID NO: 1024463 - protein, 155 aa, Homo sapiens
RTRLQGGAAQAQARVSVPPRVVLAPAPANPFEFGRGREILANHGGALLTPANGSSGRLRGDASGGRWTVMAARRGALIVLEGVDRAGKSTQSRKLVEALCAAGHRAELLRFPERSTEIGKLLSSYLQKKICRLPLLPRSWGALGTPVVGTLAVWT

SEQ ID NO: 1024464 - protein, 253 aa, Homo sapiens
MAARRGALIVLEGVDRAGKSTQSRKLVEALCAAGHRAELLRFPERSTEIGKLLSSYLQKKSDVEDHSVHLLFSANRWEQVGRQSLILSPRLECSGTISAHCNLCLLSSSDYPASVSRVSGMPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 1024465 - protein, 114 aa, Homo sapiens
MAARRGALIVLEGVDRAGKSTQSRKLVEALCAAGHRAELLRFPERSTEIGKLLSSYLQKKSDVEDHSVHLLFSANRWEQVQGLCVMQAECSAQSQLTAASTSRVQVIFPPQPPK

SEQ ID NO: 1024466 - protein, 142 aa, Homo sapiens; identical to SEQ ID NO: 1024456

SEQ ID NO: 1024467 - protein, 193 aa, Homo sapiens; identical to SEQ ID NO: 1024461

SEQ ID NO: 1024468 - protein, 212 aa, Homo sapiens; identical to SEQ ID NO: 1024455

SEQ ID NO: 1024469 - protein, 188 aa, Homo sapiens
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKELQLADAAKRGAFGHERYENGAFQERALRCFHQLMKDTTLNWKMVDASKSIEAVHEDIRVLSEDAIRTATEKPLGELWK

SEQ ID NO: 1024470 - protein, 151 aa, Homo sapiens
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLHLQLRMPRGSYGSDPSCH

SEQ ID NO: 1024471 - protein, 69 aa, Homo sapiens
KVAIFVGGVQLWRLLVSNSQDAAESAGSSSDWAEDDKHCFPEHFKNKVPEKQKLFQEDDEIPLYLKGGV

SEQ ID NO: 1024472 - protein, 64 aa, Homo sapiens
MHIWIAVLHFQVTSLGSWLSYWIRLSRISRCLQPTPLLQTAANTSFCQQTYATTAIAITDLTKM

SEQ ID NO: 1024473 - protein, 133 aa, Homo sapiens
MHIWIAVLHFQVTSLGSWLSYWIRLSRISRCLPNSHSRICLPELRRPYLPFSSVPTRPYCYSLAIASPAAIFTNKNCGSSVMEDFTSGGIRAGTTSSLDSDPDQLAVPTRSLSPVSETHFPPHPQRPHCVPAT

SEQ ID NO: 1024474 - protein, 45 aa, Homo sapiens
NSLTAADTAVYYCARDRGGVIDGNYREYYYGMDVWGPGITVAVSS

SEQ ID NO: 1024475 - protein, 183 aa, Homo sapiens
MDTRVTVRCLVLTVTWQCTKRAYTHELNLGVARECEPEMMPLMRLGSTAQLHPIPTVASPKMLRKRTSNGDFGSLSSCVLWDAADAVSLAVSDIPGEAMVKLYCPKCMDVYTPKSSRHHHTDGAYFGSGFPHMLFMVHPEYRPKRPANQFVPRLYGFKIHPHGLPGCKVPAASLFFSPVKKIR

SEQ ID NO: 1024476 - protein, 75 aa, Homo sapiens
EIWLGLNDMAGRGHLALDMTRRPHRLQELADMRSPRNPMAGKTENCAVLSGAANGKWFDKRCRDQLPYICQFGIV

SEQ ID NO: 1024477 - protein, 166 aa, Homo sapiens
SGAEAEWECGKRRIPGGRRGFPYPDPARVLASPAEGALAEWVGARLAAARFRRQELELGSGARAGVPTEPGGTGVVERERGREVPGSPNRNVQARSAPAGQTFVLSAREAESRAGGAGATETVPALGADGIARGRYPLEGSPGPWPDLVLRSRALGHAQREEGERC

SEQ ID NO: 1024478 - protein, 320 aa, Homo sapiens
LTGLGPVTSLIAPSSLSAAMIARQQCVRGGPRGFSCGSAIVGGGKRGAFSSVSMSGGAGRCSSGGFGSRSLYNLRGNKSISMSVAGSRQGACFGGAGGFGTGGFGAGGFGAGFGTGGFGGGFGGSFSGKGGPGFPVCPAGGIQEVTINQSLLTPLHVEIDPEIQKVRAEEGEQIKLLNNKFASFIDQGQFLEQQNKVLETKFVILLQQNMRTTTSRYKTLRPLFETYLSVLRKQLEYLVALTKGALGSGAEDHARTSGDLPLSFDTAITNALSAMNGAKRVEANYQGSGTCRKGGTSEGHTWADSPRPVPRTARAICRAK

SEQ ID NO: 1024479 - protein, 124 aa, Homo sapiens
GRREKSTCPGSTLKWFSGLGRESGWGPRCSSILCPWSQQAAPASRVLLGLILPPNELRSRPSRGGTWSDSVGLGGPALLTPPGGPFSTARGGCGRGAEGGTTTGREHGAGNPWAPVGGLWSSGR

SEQ ID NO: 1024480 - protein, 229 aa, Homo sapiens
RRGEEMRRGMEVYVTEEAAALLPQRPGPLKPGESPPRDEDAPARGNAPAAFAAPKRAVPSKPQPRPDTLILIPSRTGLCEDPRRAELRASNGTGCKTGQEWTSQDAGLAKGPWHASHPKGPRAIRGTSGSRPRPSFDHTKRSKYQHYSSQSLGNNGGKTMHIPQRPAESQLRRGTNREESPKVPPTQTDKHKRRSVGAENKPEATLGKNNPHTSDPPRTRTKKARGGRP

SEQ ID NO: 1024481 - protein, 235 aa, Homo sapiens
SGGRGLTLIQPGKVRRVEAGAELAAPSSAGGLSPVAGQTKEAARVGQARPAVAERSVWPVRGGCALLALCGALVACGWLLGADAQDALWSPAAGIDGGLRRVMRQVGRAFFLSMYLTRILLVAARRRLVSGVVLLVHRHLQDLHGVVRILLKGRAAPWSSVRLSVEPLCVQCILVSLNFKDIGNMHGTLRLLDENVVIFLGPGTYATVYQQGELDNLSILILQYPQFACMPFPET

SEQ ID NO: 1024482 - protein, 324 aa, Homo sapiens
SGGRGLTLIQPGKVRRVEAGAELAAPSSAGGLSPVAGQTKEAARVGQARPAACDSRQQNGTGLSGASALHELHDGWWTRGHAMTGWLPWAARKTQVARGARRTRHEAAPGRMLARRTASPSITSRYPGACARRLVSVWACGCTGPVTQDLHAWGSSLRWRRDAPGRRGCHGTSSWRFPLRLWCVVADSLRHYHLGEILATWGKLDGPWFGTEVQLLQCSLCAPSYLMQNGIPRMVGTGRTILSNAWILTRLPPRSFDRFNWPFPLGKPQELELFELKGDNGGSYKPLGVWKSFDCEPLGFGVRASDKAKVDPQGEDYRFSWKPP

SEQ ID NO: 1024483 - protein, 369 aa, Homo sapiens
MAQEPVTFRDVAIYFSREEWACLEPSQRALYRDVMLDNFSSVAALGFCSPRPDLVSRLEQWEEPWVEDRERPEFQAVQRGPRPGARKSADPKRHCDHPAWAHKKTHVRRERAREGSSFRKGFRLDTDDGQLPRAAPERTDAKPTAFPCQVLTQRCGRRPGRRERRKQRAVELSFICGTCGKALSCHSRLLAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTRHQRTHRHGEV

SEQ ID NO: 1024484 - protein, 610 aa, Homo sapiens
MDMAQEPVTFRDVAIYFSREEWACLEPSQRALYRDVMLDNFSSVAALGEHGLSAAWAQGFCSPRPDLVSRLEQWEEPWVEDRERPEFQAVQRGPRPGARKSADPKRPCDHPAWAHKKTHVRRERAREGSSFRKGFRLDTDDGQLPRAAPERTDAKPTAFPCQVLTQRCGRRPGRRERRKQRAVELSFICGTCGKALSCHSRLLAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTLASEDSQARGGVGAPEEWGAAPLREYWVLRESCSEKLLFSLENQPEFREAFLVLRAPQSPEKFTGKTARWEKQSHGYAGDGGGSGDGGGCARRRASWGCAESVRDPGATCQAGLRGGEACLVPTAVWLRDSTLAPSRRLLGLSFLALHPMLAARSGFPSCLCLGRGSCEHCTEAKTLLQPLRWAVETRAFVILNLIQGLGVVVRSGPPPVLQERPPPSSVGQSLGHAPGVGRSSWVSGQ

SEQ ID NO: 1024485 - protein, 645 aa, Homo sapiens
MARYRSPQLLPPGFKWISCPSLLSSWDDRSALLGTVLPQRGGLAVPMDMAQEPVTFRDVAIYFSREEWACLEPSQRALYRDVMLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERTDAKPTAFPCQVLTQRCGRRPGRRERRKQRAVELSFICGTCGKALSCHSRLLAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTRHQRTHRHGEVYGAPEEWGAAPLREYWVLRESCSEKLLFSLENQPEFREAFLVLRAPQSPEKFTGKTARWEKQSHGYAGDGGGSGDGGGCARRRASWGCAESVRDPGATCQAGLRGGEACLVPTAVWLRDSTLAPSRRLLGLSFLALHPMLAARSGFPSCLCLGRGSCEHCTEAKTLLQPLRWAVETRAFVILNLIQGLGVVVRSGPPPVLQERPPPSSVGQSLGHAPGVGRSSWVSGQ

SEQ ID NO: 1024486 - protein, 72 aa, Homo sapiens
EGGLTFQVLDNAPQAVPVGCNEHSLAGLDLGNLQERRVLGLGQGLSGERGGCRRSPRCLPTHVKLNPPPPPP

SEQ ID NO: 1024487 - protein, 180 aa, Homo sapiens
EGGLTFQVLDNAPQAVPVGCNEHSLAGLDLGNNLLVPEGQGPGNGVHEALAGGEFPGLQACVPTLLGDTCTLLSLPSQWARTRLPTLQLYQRPSQQRQPTLLMELQYGCFSSIWGSGMSKERLQIFTWFYPCFGGRFCLVEACEAPVMPLIEAPSAHHMQSHLVRAGQDGPTGADGPVHH

SEQ ID NO: 1024488 - protein, 107 aa, Homo sapiens
RSESTQSLRYLGNPLLPSWMCGLSDIVKRRRGRGKTLPPVCRQRAPRSREASAPGVTAANALLPSVSLPQLPSPSLLSLLPFLPAAKHTEPSDLQAQCRALALHGHK

SEQ ID NO: 1024489 - protein, 167 aa, Homo sapiens
RVVPAVHGGAVSFGNPGRTGHPEAVLSWRSGSSMSRTLASAVPLSSSRLLRDGWANSSSGLRAHVTKKEHWHLDKDTFDELLSLLSTLQELNAENIVNTNRIILTGHYVTLTRRLILETKNIYTADLSVSKAHVVHFTTNTEKLQKLKLEYETHNLRRCYAQKIAWD

SEQ ID NO: 1024490 - protein, 108 aa, Homo sapiens
MASRISGLYRMPDALAGQQFTSRDEDPYCVSCFGEFFAPKCSSCKRPIVGLGGGKYVSFEDRYWHHNCFSCARCFSIPGGPGLRTGWRHKCSAKGCELRQGPNARVFL

SEQ ID NO: 1024491 - protein, 118 aa, Homo sapiens
MASRISGLYRMPDALAGQQFTSRDEDPYCVSCFGEFFAPKCSSCKRPIVGLGGGKYVSFEDRYWHHNCFSCARCFSIPGGPGLRTGWRHKCSAKGCELRQGPNARAPGPTGPGLWLLF

SEQ ID NO: 1024492 - protein, 307 aa, Homo sapiens
MTPPRASPRTPPRASPTTTPSRASLTRTPSWASPTTTPSRASLMKMESTVSITRTPPRASPTGTPSRASPTGTPSRASLTGSPSRASLTGTPSRASLIGTPSRASLIGTPSRASLTGTPPRASLTGTSSTASLTRTPSRASLTRTQSSSSLTRTPSMASLTRTPPRASLTRTPPRASLTRTPPRASLTRTPPRASLTRTPSMVSLKRSPSRASLTRTPSRASLTMTPSRASLTRTPSTASLTGTPPTASLTRTPPTASLTRSPPTASLTRTPSTASLTRMPSTASLTRKSNVNQQCPASTPSSEVIS

SEQ ID NO: 1024493 - protein, 180 aa, Homo sapiens
SGVAAVDGCEALSQGPGAAVGSAGRTSRSVRGLRGRGAAEWSKPSLASGQACVTLVCESLLSPEVMLLSQARYSDAVRSCVEEQLQFTILSLVAAYPVQLVPGSFVMHTRGDPGMYDLYDADPSGSPLEDKPVLFSQTATGPTCPSKAVYQKFGKFYLIETVNIWSHLLGFLSLLHPGNI

SEQ ID NO: 1024494 - protein, 274 aa, Homo sapiens
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKGETRKGSGPRPGRAQNLTFIKSPHQNKSPRGAWWRDFHHIFGICWPF

SEQ ID NO: 1024495 - protein, 888 aa, Homo sapiens [sequence omitted]

SEQ ID NO: 1024496 - protein, 517 aa, Homo sapiens [sequence omitted]

SEQ ID NO: 1024497 - protein, 888 aa, Homo sapiens [sequence omitted]

SEQ ID NO: 1024498 - protein, 687 aa, Homo sapiens [sequence omitted]

SEQ ID NO: 1024499 - protein, 134 aa, Homo sapiens
AHLCETFWCELYLKNGRPRRRARHAHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 1024500 - protein, 99 aa, Homo sapiens
SALHSQVFPALTPKRWTQVRRGTATVGGMAILQVTAGHPLAMAQALRATPPPWSRALRAPLAMAQVPAGSPATMVQALRASPWPMAQVTHPPGPTSLRK

SEQ ID NO: 1024501 - protein, 317 aa, Homo sapiens
GTRRSWWVLAPLTPLFAAPFGSVLVWSIHLSGGPSCPLPPVFPLFPYTFPGPCGGLAGASVLAFPTVISPSHTRDIEVCLGRFHVCRATCQVLISRRDHLVHGTQAPSDSSDSPVVPVCCHYSSFWLAAIEVSPGSTDCEVSLFFFSNVAYHGFCLLCSLKPCESCCVQAGPVACWAEGSQSSTGRLIEVSHLGYLLLPSRPVRPPPTSPAPAWSPRDYVALYDHVDPPEHTPCTLAPAHGTAIPCAWISPHHFVPDDLSDQLCRPCVVRGSVINSDGGRHSLVHQHWATAYPCPPIRFGCYGKGMFRTVHFPQCRH

SEQ ID NO: 1024502 - protein, 83 aa, Homo sapiens
PTCPSEAAWPWRRGWITVAQTHCHSGQLPCLHRRCYGKGMFRTVHLPSMSALSGPAPPSPATPLPSWAILLDGHLGGSGFYFC

SEQ ID NO: 1024503 - protein, 245 aa, Homo sapiens
APASRCNILSYDYSGYGASSGQGLPTRNLYALTSDGRMARPCASRYGISPDSIILYGQSIGTDAHQLDLASRYECAAVVLHLRRSPRECASPSPDTKKTYCFDAFPNIEKVSKITCSRAHHPAVTEDEVIDFSHGLASLRSSCTQERMVAACWVEGSGHILIIESLQPVILDAHCVRFISQELPSHARLAERPHIGQDLMQQRQAPGPHPTRTGPHTWGMHVTPAGRHQGAPPRSKGAVDDVQAT

SEQ ID NO: 1024504 - protein, 331 aa, Homo sapiens
APASRCNILSYDYSGYGASSGQGLPTRNLYALTSDGRMARPCASRYGISPDSIILYGQSIGTDAHQLDLASRYECAAVVLHLRRSPRECASPSPDTKKTYCFDAFPNIEKVSKITCSRAHHPAVTEDEVIDFSHGLASLRSSCTQERMVAACWVEGSGHILIIESLQPVILDAHCVRFISQELPSHARLAERPHIGQDLSNKGRPPDLTPVAGLRAWGCVCDSCCSIQGDLDPFQGLSTIVQAISPSDCCLTVRVKASTDSIVRNRKILTHYEESESRCLVDGGQRVKAEAVGLCSTVDDVSEDPGPTWTQVFFDLMQRNQNERPMSENND

SEQ ID NO: 1024505 - protein, 81 aa, Homo sapiens
GPGPPCPASLVLRASSGLPQPRGGNLVGTREPLLSQAIGRHWAIERLSRTCVDIGGRQEGAAPQCFYVISTFTAMNPALLQ

SEQ ID NO: 1024506 - protein, 145 aa, Homo sapiens
LAGYSEYMDPVIGSGAADEGRPFLGPGPFRAAGASAWRNPIPFPETFDGDTDRLPEFIVQYVLLTMFVDEYTFSNDALKTYATTAIAIHRIITNRLWLLVMWTLGGIRAGHSPWDSDPDSWPFPKGALFNFRPFSPFPRELCFLK

SEQ ID NO: 1024507 - protein, 128 aa, Homo sapiens
PLRLKVKNQWQEAFGGADDRTSPGTALWRSIIMQKPESVDKFFKRVNGKDISSPAFQAHIQRVFGGFDMCISMLDDSDVLASQLAHLHAQHVERGISAEYFDVFAESLMLAVESTIESCFDKDAWSQC

SEQ ID NO: 1024508 - protein, 710 aa, Homo sapiens
MDRSQQTSRTGYWTMMNIPPVEKVDKEQQTYFSESEIVVISRPDSSSTKSKEDALKHKSSGKIFASEHPEFQPATNSNEEIGQKNISRTSFTQETKKGPPVLLEDELREEVTVPVVQEGSAVKKVASAEIEPPSTEKFPAKIQPPLVEEATAKAEPRPAEETHVQVQPSTEETPDAEAATAVAENSVKVQPPPAEEAPLVEFPAEIQPPSAEESPSVELLAEILPPSAEESPSEEPPAEILPPPAEKSPSVELLGEIRSPSAQKAPIEVQPLPAEGALEEAPAKVEPPTVEETLAEVQPLLPEEAPREEARELQLSTAMETPAEEAPTEFQSPLPKETTAEEASAEIQLLAATEPPADETPAEARSPLSEETSAEEAHAEVQSPLAEETTAEEASAEIQLLAAIEAPADETPAEAQSPLSEETSAEEAPAEVQSPSAKGVSIEEAPLELQPPSGEETTAEEASAAIQLLAATEASAEEAPAEVQPPPAEEAPAEVQPPPAEEAPAEVQPPPAEEAPAEVQPPPAEEAPAEVQPPPAEEAPAEVQPPPAEEAPSEVQPPPAEEAPAEVQSLPAEETPIEETLAAVHSPPADDVPAEEASVDKHSPPADLLLTEEFPIGEASAEVSPPPSEQTPEDEALVENVSTEFQSPQVAGIPAVKLGSVVLEGEAKFEEVSKINSVLKDLSNTNDGQAPTLEIESVFHIELKQRPPEL

SEQ ID NO: 1024509 - protein, 310 aa, Homo sapiens
RTVQAPKPPPPDRCRFLPCPDRQQADSCPIIWGYRQYDNGSCSTGSKDFPIAKGERQILLLTVDTHTAKYDPSLKPLSVSYDQCNFLCRILKQIGQCFQAWSLSDSQGQQQCVKGWTPGLALTDLIHVALSLGVHFAWHKVQSTTCGIHPDYMLAELHLVHWNTKYGPFWDKLCINLMDCAAASVIHLFDRLGSAKPGLQKVVDCAGIPFPDKGKSADFTNFDPRGLLPESLDYWTYPGSLTHPPLLGMCDLALCSRNPSASSSEQVLKFRKLNFQWGKGEPEELIGGPPGRQVQTLKNRQSKVSFNRWS

SEQ ID NO: 1024510 - protein, 239 aa, Homo sapiens
RRSRMAVEQPWRPVRNGMDLKPHFHKDWQSAPAATWFNQPARKIRRCKARLRPTARRIAPPPASGPIRPIVRCPTVRYHTKVRAGRGFSLEELRVAGIHKKVARTIGISVDPRRPDTSSTESLQANVQRLKEYRPELILFPRKPHSAPKKGDSLQQNLKLAHPADRTGHARSGTVSYTRRQLTHSPEDTEDSHAFAHSSHGPATPGILRDTGTHDHGKARTRCRHERLQPSGALATQNQ

SEQ ID NO: 1024511 - protein, 999 aa, Homo sapiens
MENLESRLKNAPYFRCEKGTDSNPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISKMNRLFSGKGDITKPGYDPCNLLVDLDDIRDLSSGFSKYRDFIRYLPIHLSKYILRMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWVQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKMVVNTESNVLMFQFEHIKWQYAVEKTKQKKNKEKEEEKEENSLMEILSKCNIQVHSPRESVSSKQTVIQELLPGKPPKSRVLLKPAKFSSAVLIEELQSQGKSKSPRRDADDVEKAQKQGQLETPGKLPSHPKKKSWKIPMSPDQFLLTVSTLQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 1024512 - protein, 185 aa, Homo sapiens
RVRPPPTAAGGSGDGVGSLAQSPECEDSDHPALAWPGGCRELPFLSSGAKVARRQRLLPSTSSSSPLRRSCGDVAPLTPLLPDPVSPRGGNELSPTSPEETALDPQALPGKAVSYQSSRQPPPPAGGSPNVGVPVDHNHSMENESLFTFTYGKTLCDYVFRQWLQLYCSQIRNCTVAQRRASGVA

SEQ ID NO: 1024513 - protein, 117 aa, Homo sapiens
MTKIKADPERARGSGGGVFRGAHLYQELLVNQNPIQLAVPWLSRRLKRKLYKCLKKAVKQKPDSAAGGERGPDNFVKQREKKGIMVWGRRHTCHVRYTAISQSCVRTEIVPYVYIPL

SEQ ID NO: 1024514 - protein, 233 aa, Homo sapiens
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAA

SEQ ID NO: 1024515 - protein, 939 aa, Homo sapiens
MEESEDSQSDSQTRISESQHSLKPNYLSQAKTDFSEQFQLLEDLQLKIAAKLLRSQIPPDVPPPLASGLVLKYPICLQCGRCSGLNCHHKLQTTSGPYLLIYPQLHLVRTPEGHGEVRLHLGFRLRIGKRSQISKYRERDRPVIRRSPISPSQRKAKIYTQASKSPTSTIDLQSGPSQSPAPVQVYIRRGQRSRPDLVEKTKTRAPGHYEFTQVHNLPESDSESTQNEKRAKVRTKKTSDSKYPMKRITKRLRKHRKFYTNSRTTIESPSRELAAHLRRKRIGATQTSTASLKRQPKKPSQPKFMQLLFQSLKRAFQTAHRVIASVGRKPVDGTRPDNLWASKNYYPKQNARDYCLPSSIKRDKRSADKLTPAGSTIKQEDILWGGTVQCRSAQQPRRAYSFQPRPLRLPKPTDSQSGIAFQTASVGQPLRTVQKDSSSRSKKNFYRNETSSQESKNLSTPGTRVQARGRILPGSPVKRTWHRHLKDKLTHKEHNHPSFYRERTPRGPSERTRHNPSWRNHRSPSERSQRSSLERRHHSPSQRSHCSPSRKNHSSPSERSWRSPSQRNHCSPPERSCHSLSERGLHSPSQRSHRGPSQRRHHSPSERSHRSPSERSHRSPSERRHRSPSQRSHRGPSERSHCSPSERRHRSPSQRSHRGPSERRHHSPSKRSHRSPARRSHRSPSERSHHSPSERSHHSPSERRHHSPSERSHCSPSERSHCSPSERRHRSPSERRHHSPSEKSHHSPSERSHHSPSERRRHSPLERSRHSLLERSHRSPSERRSHRSFERSHRRISERSHSPSEKSHLSPLERSRCSPSERRGHSSSGKTCHSPSERSHRSPSGMRQGRTSERSHRSSCERTRHSPSEMRPGRPSGRNHCSPSERSRRSPLKEGLKYSFPGERPSHSLSRDFKNQTTLLGTTHKNPKAGQVWRPEATR

SEQ ID NO: 1024516 - protein, 71 aa, Homo sapiens
MKGRINKELDGTIICHQRSSRAIDRAVAGSMVRAEREPSAPLIATTAGDGTDRQDVQHMAGSISSTDANET

SEQ ID NO: 1024517 - protein, 90 aa, Homo sapiens
GREGVEVSRMEPSPFGDVSSRLTTEQILYNIKQEYKRMQKRRHLETSFQHDRSVLHFWMHSHMHFSSRGPASPGTSYCSILTIKKRTALI

SEQ ID NO: 1024518 - protein, 724 aa, Homo sapiens
MTEVPTYTVITLNVNGLNCPIKRQIGKIRGKKHDSTIHDLQETHFRSADTNCLKVEDGKRHCMLTVIKREQGGILQIYLSTSFTTLHKFCYVVFLFLFVSSIFFFKSLFLIKNDNRQEKYILVIYCTGWYHTLIIMYHIIQNFENSGFEMSPQRNKYEEVMDIFISLNISFGDFFCDFFGDFFFIYLLFKSVVFNFHKFDEFSNLLLLLISNFILFAIGEYILHDISNKSQSDRSPHLTVITLNVSGSNCPIFKFIYTYICGLTYGISQKMFRVHLGRMCMLLLLKDDSVYICYSYLTVLFKSSISFFIFFVILSIIESVLLKFPTITVELSISSFNSVSFCFICFSGATIKYVNVYHRYIFLAKLGMRVLGDRLFILVKIHFTKFRVYVQFIWHCWIDIVLADMFYLGWLVDFVIFLYQNTESVLNNKNKNKPQFCKELQNANLWDFGYVKKLVESSLKFCSTWHYLKERDNFLFWKDLGGIVSKTNLLMVYFFPLSLIVNNCPPREAQIKILFILSFHFYPVSSNNHRSLLVFISGKTIKDYHFLGEMVLLHSTNLVINHEGLVFVPWFHILKYSVFILNFNICSNEIVNIYSIVFIFVILDSLKPRKSKHIIMSHHPVSCKNLSLIFFLSFTYKLFTYVVEFTTTSEMGYLWRGRECRGKNEYPLAISVILYFSTYRKYEVTTAECWIKFNSGVVNKIISILLDDGLEVNLLKKKFTLFPK

SEQ ID NO: 1024519 - protein, 202 aa, Homo sapiens
MRHCTTYGLITDKLAYKEQNEGAVHAVTGSALAFTPVTFANDLTIYITESSWRAEANIDSKCALEPGFLEAWILRATRSPYLSKPLRYFETFSIEIEMTCTLGGEIQNDNWRLREERRKSQEAQVLKQLAEKREHEREVLQKALEENNNFSKMAEEKLILKMEQIKENREANLAAIIERLQEKERHAAEVRRNKELQVELSG

SEQ ID NO: 1024520 - protein, 144 aa, Homo sapiens
VGSARRLQRSDGPEIGCRAPHLHLSGHAPLACPCSFLPTSLGGVCVSAPAPALLSWGTLPAIWYWGCPHCLVLGPGPGPLWAGFTCLFLMAGRPRNSPIRAGRNRRESLSAGIFELFVLFCKKRLTSKLHKSLFVPTEFSTPHT

SEQ ID NO: 1024521 - protein, 125 aa, Homo sapiens
RERGRPDPRAELLFRRGSAGGRLPQSSSHQSSVRPSSEPRSRRLSSLGVTRCSIRGLDPTLGHPDDWSSVYQSRVPHKSESRTRQSLPSPVTGELPGLQMQTWTLGPRRLWVHVRVRVFAAWCQG

SEQ ID NO: 1024522 - protein, 241 aa, Homo sapiens
MGFHLRIVHGSPNLEAVALLISKRPKGHTNGGNFPRFFILGTPVVTRFTASSYKVNPHFYRTSAPLIPGSSQLLFAPIVPVRKTSFTPPVKKPQQFSSMSCSLSLHSRAIHSYFLSMLTKHTSNTAEGKESVFVSKCRFLANSRMRWYHEEYLEHHTSRLRRTSYVGHNSCWVALVLLAWMWGLQGNYLVLILVLDVFPQLPLVDVVVDSVRALIEGALEEHDATQMMVRAKVEVLRNRQG

SEQ ID NO: 1024523 - protein, 155 aa, Homo sapiens
MRGAALLLMSADSVARCCSGPLGRGDTFDVGVLAPKRQRGQARCLPALEGPPGLGGRVSTQRSGEEARSLVSSPGAEGKCVLLQKVLTQVSALRTQNSQVMDQVQREGGPQPTPAGEEEGLKVGGQLHEQPLFLTSRSARQGEVSMSRRERTSTL

SEQ ID NO: 1024524 - protein, 155 aa, Homo sapiens; identical to SEQ ID NO: 1024523

SEQ ID NO: 1024525 - protein, 114 aa, Homo sapiens
MQPESSCQAGVFVGSSAMRSTVTPLKRPGISGFPRQQALPTPVIYPPWQILVDRAVTVCQLGIRQRLKSFLTGSGVHSSGGRRFIGGLRKKHQTFGSLGRGLAELAERGGEACV

SEQ ID NO: 1024526 - protein, 178 aa, Homo sapiens
TIEEEGSEVGSAGEDNPAGQMNPGWKPSDGGCELPDAVGKEHPSSDGAVVAPAPKSEEKDAAEIQKRKRLEQAGIKVMPAAQRFASQKQLSEEKEAIRDIVLRKENSFLTHQHGNDSEAEGEVVCRLADLEKDDFAAGKARMNQTKPMVPLNQLLYGPYPKKGAEKSDGSKQLSKGIS

SEQ ID NO: 1024527 - protein, 79 aa, Homo sapiens
MAPAAATGGSTLPSGFSVFTTLPDLLFIFEFVSGSEFGDERELIRFIFFWPFKVSGEGTYLRPIRSGNEAIVCLAAVLL

SEQ ID NO: 1024528 - protein, 57 aa, Homo sapiens
MAPAAATGGSTLPSGFSVFTTLPDLLFIFEFVSGSYIATLLYVVHAVFIFNQMEVFI

SEQ ID NO: 1024529 - protein, 49 aa, Homo sapiens
MAPAAATGGSTLPSGFSVFTTLPDLLFIFEFVSGSWSEGTGWAEPLSSA

SEQ ID NO: 1024530 - protein, 326 aa, Homo sapiens
CCCARLKVSVMQDRQFSFEFFPPKTAEGAEKLRNTRAQLSPLKPRFISVTFGAGGTTQQGTLDAVVEIQREGIEAAPHLSCVGSSRESIRGILNTYREHGIRRIVALRGDMPSGMGEIGEFRFANELVEFIRQETGEAFHIEVAAYPEYHPQSRSARHDLENFARKVKAGADSAITQYFFNADAYFQFVDDARKLGVDVPIVPGIMPITNSSQLMRFSEMCGAEVPRWIAKRLEGFGDDRESIRASAGRGDGHVRPLLQAGAGPAISTRSIAGRSTRAIWQRSGLVNADCGKAQGDRPGRPTPIRCFAWVLDEPPGRSRQILEIRA

SEQ ID NO: 1024531 - protein, 303 aa, Homo sapiens
MEHPLFGCLRSPHATAQGLHPFSQSSLALHGRSDHMSYPELSTSSSSCIIAGYPNEEGMFASQHHRGHHHHHHHHHHHHQQQQHQALQTNWHLPQMSSPPSAARHSLCLQPDSGGPPELGSSPPVLCSNSSSLGSSTPTGAACAPGDYGRQALSPAEAEKRSGGKRKSDSSDSQEGNYKSEVNSKPRKERTAFTKEQIRELEAEFAHHNYLTRLRRYEIAVNLDLTERQVKVWFQNRRMKWKRVKGGQQGAAAREKELVNVKKGTLLPSELSGIGAATLQQTGDSIANEDSHDSDHSSEHAHL

SEQ ID NO: 1024532 - protein, 267 aa, Homo sapiens [sequence omitted]

SEQ ID NO: 1024533 - protein, 188 aa, Homo sapiens
MGSPPRRGRHQSPPAQSWGCSWMLSGRLAHGGHPHLPVHVTAFRAWVTWTLNSGEFSLRSREKEDSSLEGFPGPITERMRRERSWSGTQLRWQCNAGKLYCMKSLSLPLPPSFTWTLPKTRIPECSGVTKCSGTLGTRVWSQAAGVCILVLPLLSWLTWHKPLTLSEPYCLQWQMDLSTGPIAWGCYC

SEQ ID NO: 1024534 - protein, 146 aa, Homo sapiens
RKFMCLSLQQLKSQPSIWTQPNHITCFIPHFWKQLIIHIWLSSCSRNAWLLMNWDSRENDPTLDLLTGFPSLVVSGEIFVILVSFYNTLKIWNYFGCLQISFLFLFSPEFRSSLPGLQWQWHDLGLTAASASQGESLETQKDEGWQ

SEQ ID NO: 1024535 - protein, 335 aa, Homo sapiens
VAGASPPGPRRALCPGRARADACTPRVRGGVESAHGSAREQLAPAGRRRRAPLRQASSEHARRRRARPLPPALASELADCAAGRSRAGAAAAGGYSARGSPASPPPRRELAPSPSRAPTPAFFRRRWAAPPSGRSPALHNPLRLSMFHTPRPEPPRLLFFPPPPSPPHSCLHFLKEGFFSLSLPHTVAARDGPGGRPSFPRDNFTKMSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGVFFLDITFSSDYFKPPKVTFRT

SEQ ID NO: 1024536 - protein, 324 aa, Homo sapiens
VAGASPPGPRRALCPGRARADACTPRVRGGVESAHGSAREQLAPAGRRRRAPLRQASSEHARRRRARPLPPALASELADCAAGRSRAGAAAAGGYSARGSPASPPPRRELAPSPSRAPTPAFFRRRWAAPPSGRSPALHNPLRLSMFHTPRPEPPRLLFFFFSNYFNFFNFFFFFFSHVSARGGLLNFPRDNFTKMSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGVFFLDITFSSDYFKPPKVTFRT

SEQ ID NO: 1024537 - protein, 78 aa, Homo sapiens
KQWYQRRVAITAGDLSELAADLWCVLSRLSCAKMLQSIIKNIWIPMKPYYTKVYQEIWIGMGLMGFIVYKIRAADKKK

SEQ ID NO: 1024538 - protein, 78 aa, Homo sapiens; identical to SEQ ID NO: 1024537

SEQ ID NO: 1024539 - protein, 78 aa, Homo sapiens; identical to SEQ ID NO: 1024537

SEQ ID NO: 1024540 - protein, 78 aa, Homo sapiens; identical to SEQ ID NO: 1024537

SEQ ID NO: 1024541 - protein, 47 aa, Homo sapiens
ILLTLKYGEEAMMLDTLSKSIFSTMFLGLMLSSGLQMKICPDSSALH

SEQ ID NO: 1024542 - protein, 257 aa, Homo sapiens
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 1024543 - protein, 116 aa, Homo sapiens
MPMFIVNTNVPRASVPDGFLSELTQQLAQATGKPPQYIAVHVVPDQLMAFGGSSEPCRALQPAQHRQDRRRAEPAPTASCCAACWPSACAISPDRVYINYYDMNAANVGWNNSTFA

SEQ ID NO: 1024544 - protein, 200 aa, Homo sapiens
EVADPPYATSDDAYGSQAAGGSFALSLIRVMNASPAPGTTAEEAMSRGSPPAPEGGSRYEQDGRFNWIHTPWACAVSPKWVPSLSTQAYSEPAGQVKSPDPSVSYAYLRWYVCHENAETMPVYGAQMLLSDAVQPGHAKAVGSSAPEKPREPVAVDLEAPEVQESYRQQLRSDIQKRLQEDPNYSPQRFPNAQRAFADDP

SEQ ID NO: 1024545 - protein, 164 aa, Homo sapiens
VRPGEQERRQPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGCFLFGLCHQPVFSQDIGQSVPLGAPAFLTSLSVCTPNFTQIN

SEQ ID NO: 1024546 - protein, 79 aa, Homo sapiens
VRPGEQERRQPALNNNPRRSGSKRVLLICLDLFCLFMAGLPFLIIETSTIKPYHRGFYCNDESIKYPLKTGETINDAGR

SEQ ID NO: 1024547 - protein, 139 aa, Homo sapiens
ASVPRCCGGQPGGEVEVAVGGYGTSWRVPWRRSAAIYSSVGPAVSLRHAEDGAVKESGRLAGSQFQQSRCSHGPNQGGRCHPAVEVFEGEPGNKVNLAELVQGQEGCVLSSWPFTPGFFQDTPARVCWSRLKVLGQGIP

SEQ ID NO: 1024548 - protein, 397 aa, Homo sapiens
MGLAGVCPETLSGYILVGGAGGQSAARQKDGAVKESGRLAGSQFQQSRCSHGPTLLHRTVLLPLPVEAERRSATDVVYSPLIGSKTVRSEEEEWVSWLGSVSVSKSTLSSPGFARSKAGRDVNPQRGDRVGGRELRGVKDVTLVESSYMGARTGVRRDRDVRLRGLLSSIGTVGSHTTKARAGVRANSIDASGGPMGSRELSVLVESSFIDGFRGVSRWEGPRIVERRDGQRWAPGIDRHSKDYVDKELRVYDVKLIFAACPSLVDIRGHNEVCEWWYRNVRQNCSLNGATCEWCEALNMKLTHPIIIYRSEGLGTNNSSSRSYLAATALFWRRALGNGVKITDEQTCGMRPRDTKNRAGQYEKTTHIGVQEGAYHRHTPREANRVSKKRDTYAAEQ

SEQ ID NO: 1024549 - protein, 286 aa, Homo sapiens
QQKIKRFKAKQGQNKFLSEIEDELFNPDYVEVDRIMDFARSTDDRGEPVTHYLVKWCSLPYEGSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLVSDHIGDCTEPE

SEQ ID NO: 1024550 - protein, 403 aa, Homo sapiens
QQKIKRFKAKQGQNKFLSEIEDELFNPDYVEVDRIMDFARSTDDRGEPVTHYLVKWCSLPYEGSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLEHKVLLTGTPLQNTVEELFSLLHFLEPSRFPSETTFMQEFGDLKTEEQVQKLQAILKPMMLRRLKEDVEKNLGPKEETIIEVELTNIQKKYYRAILEKNFTFLSKGGGQANVPNLLNTMMELRKCCNHP

SEQ ID NO: 1024551 - protein, 91 aa, Homo sapiens
PKLSDEIDTHRLTAPLALTAAHSIVITPTEPQVTLDVAVLGTGLRKSNYETKVMEYPTSGRNTEQLIDSLLAASQTTKWPINQENQRYQIR

SEQ ID NO: 1024552 - protein, 362 aa, Homo sapiens
RVMRLGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIGRLHLSGIDANPNALFPPVEFPAPRGTPLISPLIKWDHSLAWDVPAAEDFPNGSGSPSTASPV

SEQ ID NO: 1024553 - protein, 260 aa, Homo sapiens
LRLQHVESRSKDPFSRVPMLRRHLGVWEPSADLSVSSTYFILLKTQSECFKFLENTKSSGKLRELPLPCCLFLGSWTEPCLPTPGFASGCLCLFPGSWTESACPSPGLFPAARALVDPAVPEVILLQVIGSRESEAQAFAESISIPVGCCVFMFIVPSVLSPLELTDIPHPVLCCPLRGWGLQRERLRHPSHPCSSCSISTSCLESYLCISCGPGDMGEGAAPLGGQVAEPTAGEPLSGPGDGQLLCRAHGCPSAALREP

SEQ ID NO: 1024554 - protein, 194 aa, Homo sapiens
PLGAPPPRAHILAKGPPKAGCPPAESPPCQDPPWGRRNPSDYAPGRRPKRAAEMPFAPGTSRETPRRKWRVQRPLPSRPPKVKRSCPASKGRGQSALAVRQASVGSPTLQLRSSSDRISSGLAVSGSKVTSPRNLPQCLYQVPGPCNTVLSSIGNNFWGLQLHILDPAQGVLDVLQQPQSRQLAAALELGDELS

SEQ ID NO: 1024555 - protein, 255 aa, Homo sapiens
LGDICVGNVLQPGAGAIMARIAQFLSDIPETVPLSTVNRQCSSGLQAVASIAGGIRNGSYDIGMACGVESMSLADRGNPGQYYFALAAQKARKRQRLPDSLMGITSCTNVAERVWHFTGRTQDTFALASPADRQPEPRARASFQAEIAPGDHHGPMMTRAPRGSITCDPGLRVSAPDTTIGGPCANHLYALPFQVTDWVLTNCLDPLLAEVASMGAGCHASAAPCASRVPESAPLQPCASLGSLCTGSRSPPRIM

SEQ ID NO: 1024556 - protein, 1307 aa, Homo sapiens
GEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAVSLAELPLPTPPPAPPPEPEKEKEIHQSHVPSKTPTAKGKPQSEAPHGKQESLQEGKGKKGETALKRKGSPKGKSSGGKVPVKKSPADSTDTSPVAIVPQPPKPGSEEWVYVNEPVPEEMPLFLVPYWELIENSYINTIKTVLRHLREDQHTVLAYLYEIRTSFQEFLKRPDHKQDFVAQWQADFNSLPDDLWDDEETKAELHQRVNDLRDRLWDICDARKEEAEQERLDIINESWLQDTLGMTMNHFFSLMQAELNRFQDTKRLLQDYYWGMESKIPVEDNKRFTRIPLVQLDSKDNSESQLRIPLVPRISISLETVTPKPKTKSVLKGKMDNSLENVESNFEADEKLVMDTWQQASLAVSHMVAAEIHQRLMEEEKENQPADPKEKSPQMGANKKVKKEPPKKKQEDKKPKGKSPPMAEATPVIVTTEEIAEIKRKNELRVKIKEEHLAALQFEEIATQFRLELIKTKALALLEDLVTKVVDVYKLMEKWLGERYLNEMASTEKLTDVARYHIETSTKIQNELYLSQEDFFINGNIKVFPDPPPSIRPPPVEKEEDGTLTIEQLDSLRDQFLDMAPKGIIGNKAFTDILIDLVTLNLGTNNFPSNWMHLTQPELQEITSLLTVNSEFVDWRKFLLVTSMPWPIPLEEELLETLQKFKAVDKEQLGTITFEQYMQAGLWFTGDEDIKIPENPLEPLPFNRQEHLIEFFFRLFADYEKDPPQLDYTQMLLYFACHPDTVEGVYRALSVAVGTHVFQQVKASIPSAEKTSSTDAGPAEEFPEPEENAAREERKLKDDTEKREQKDEEIPENANNEKMSMETLLKVFKGGSEAQDSNRFASHLKIENIYAEGFIKTFQDLGAKNLEPIEVAVLLKHPFIQDLISNYSDYKFPVHIIYVVEMIVCAKGWAPLPSGKQCARWRN

SEQ ID NO: 1024557 - protein, 1306 aa, Homo sapiens
GEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAVSLAELPLPTPPPAPPPEPEKEKEIHQSHVPSKTPTAKGKPQSEAPHGKQESLQEGKGKKGETALKRKGSPKGKSSGGKVPVKKSPADSTDTSPVAIVPQPPKPGSEEWVYVNEPVPEEMPLFLVPYWELIENSYINTIKTVLRHLREDQHTVLAYLYEIRTSFQEFLKRPDHKQDFVAQWQADFNSLPDDLWDDEETKAELHQRVNDLRDRLWDICDARKEEAEQERLDIINESWLQDTLGMTMNHFFSLMQAELNRFQDTKRLLQDYYWGMESKIPVEDNKRFTRIPLVQLDSKDNSESQLRIPLVPRISISLETVTPKPKTKSVLKGKMDNSLENVESNFEADEKLVMDTWQQASLAVSHMVAAEIHQRLMEEEKENQPADPKEKSPQMGANKKVKKEPPKKKQEDKKPKGKSPPMAEATPVIVTTEEIAEIKRKNELRVKIKEEHLAALQFEEIATQFRLELIKTKALALLEDLVTKVVDVYKLMEKWLGERYLNEMASTEKLTDVARYHIETSTKIQNELYLSQEDFFINGNIKVFPDPPPSIRPPPVEKEEDGTLTIEQLDSLRDQFLDMAPKGIIGNKAFTDILIDLVTLNLGTNNFPSNWMHLTQPELQEITSLLTVNSEFVDWRKFLLVTSMPWPIPLEEELLETLQKFKAVDKEQLGTITFEQYMQAGLWFTGDEDIKIPENPLEPLPFNRQEHLIEFFFRLFADYEKDPPQLDYTQMLLYFACHPDTVEGVYRALSVAVGTHVFQQVKASIPSAEKTSSTDAGPAEEFPEPEENAAREERKLKDDTEKREQKDEEIPENANNEKMSMETLLKVFKGGSEAQDSNRFASHLKIENIYAEGFIKTFQDLGAKNLEPIEVAVLLKHPFIQDLISNYSDYKFPDIKIILQRSEHVQGSDGERSPSRHTEEKK

SEQ ID NO: 1024558 - protein, 1600 aa, Homo sapiens
GEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAVSLAELPLPTPPPAPPPEPEKEKEIHQSHVPSKTPTAKGKPQSEAPHGKQESLQEGKGKKGETALKRKGSPKGKSSGGKVPVKKSPADSTDTSPVAIVPQPPKPGSEEWVYVNEPVPEEMPLFLVPYWELIENSYINTIKTVLRHLREDQHTVLAYLYEIRTSFQEFLKRPDHKQDFVAQWQADFNSLPDDLWDDEETKAELHQRVNDLRDRLWDICDARKEEAEQERLDIINESWLQDTLGMTMNHFFSLMQAELNRFQDTKRLLQDYYWGMESKIPVEDNKRFTRIPLVQLDSKDNSESQLRIPLVPRISISLETVTPKPKTKSVLKGKMDNSLENVESNFEADEKLVMDTWQQASLAVSHMVAAEIHQRLMEEEKENQPADPKEKSPQMGANKKVKKEPPKKKQEDKKPKGKSPPMAEATPVIVTTEEIAEIKRKNELRVKIKEEHLAALQFEEIATQFRLELIKTKALALLEDLVTKVVDVYKLMEKWLGERYLNEMASTEKLTDVARYHIETSTKIQNELYLSQEDFFINGNIKVFPDPPPSIRPPPVEKEEDGTLTIEQLDSLRDQFLDMAPKECSENCFQRPSPSTCDAFSKGDRKWLHGLQAALQNFLKGYPAIVRQLHSAGRGKSDTSQKKPKELLESLLQADIVKFAHFLLDVMNVLSILSCVNKNRNSSIADIFATLESMLEMLQMYQTRLGPKERMVDSATHFHGNCLRGKENISAVRNIVLTHLIKRLQGCFRDASQNVVRATVIGSFKLWPTKINQEFGEKEVSILTAHYEPVLEAANVKLSEVDTEWSMLKLEIYARFQNIRKLTWDFVNSIYLHKYPNILTLVDLVLTLPASSAEAEHGFSQMKWTKSHMHAKIKAESIIGNKAFTDILIDLVTLNLGTNNFPSNWMHLTQPELQEITSLLTVNSEFVDWRKFLLVTSMPWPIPLEEELLETLQKFKAVDKEQLGTITFEQYMQAGLWFTGDEDIKIPENPLEPLPFNRQEHLIEFFFRLFADYEKDPPQLDYTQMLLYFACHPDTVEGVYRALSVAVGTHVFQQVNASIPSAEKTSSTDAGPAEEFPEPEENAAREERKLKDDTEKREQKDEEIPENANNEKMSMETLLKVFKGGSEAQDSNRFASHLKIENIYAEGFIKTFQDLGAKNLEPIEVAVLLKHPFIQDLISNYSDYKFPDIKIILQRSEHVQGSDGERSPSRHTEEKK

SEQ ID NO: 1024559 - protein, 432 aa, Homo sapiens
GEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAVSLAELPLPTPPPAPPPEPEKEKEIHQSHVPSKTPTAKGKPQSGD

SEQ ID NO: 1024560 - protein, 185 aa, Homo sapiens
MTHLQLKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 1024561 - protein, 333 aa, Homo sapiens
MAIKTRVVEVAAVAMDSRTVEAAAGVAVVAGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 1024562 - protein, 531 aa, Homo sapiens
MASNDYTQQATQSYGAYPTQPGQGYSQQSSQPYGQQSYSGYSQSTDTGYGQSSYSSYGQSQNTGYGTQSAPQGYGSTGGYGSSQSSQSSYGQQSSYPGYGPQPTPSSTSGSYGSSSQTSSYGQPPSYGQQPSYGGQQQSYGQQQSYNPSGYGQQNQYNSSSSGSGGGGSYGQDQSSMSGSGGGGGGGGGGGSGWWWLVMAIKTRVVEVAAVAMDSRTVEAAAGVAVVAGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 1024563 - protein, 292 aa, Homo sapiens
MAIKTRVVEVAAVAMDSRTVEAAAGVAVVAGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPFLFCRETRTLLEASLPLLLLPGTCSPFPALCLT

SEQ ID NO: 1024564 - protein, 531 aa, Homo sapiens; identical to SEQ ID NO: 1024562

SEQ ID NO: 1024565 - protein, 92 aa, Homo sapiens
WRAVTDPLGPFNFTMFLTMFGEKLNGTDPEDVIRNAFACFERKPQVSSMRTTSGAAHHHGDRFTDEEVDEYREAPIRKQNYVLPDSENGAKV

SEQ ID NO: 1024566 - protein, 85 aa, Homo sapiens
MTKSKKELKELIGIQKYLKKVGISQENKKEVEKKLTVKPIETKNKFSQAKLLAGAVKHKSSESGNSVKRLKPDPEPDDKNQEPSS

SEQ ID NO: 1024567 - protein, 216 aa, Homo sapiens
DGKSSTYINAAMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 1024568 - protein, 216 aa, Homo sapiens; identical to SEQ ID NO: 1024567

SEQ ID NO: 1024569 - protein, 216 aa, Homo sapiens; identical to SEQ ID NO: 1024567

SEQ ID NO: 1024570 - protein, 216 aa, Homo sapiens; identical to SEQ ID NO: 1024567

SEQ ID NO: 1024571 - protein, 71 aa, Homo sapiens
MEPFPSLPITQKEKWKLAAIFFKFFLRNVSILVVIIVLEDRIHHPLDVFANGFWIRFGRHSRSPVHYYWWL

SEQ ID NO: 1024572 - protein, 109 aa, Homo sapiens
MLSASRSRTAITSSLLLQLASACLRRFAEVRLQPLVLCSQVLQLLLHGRAFASTRFRRLRWMWSCVSSSTHALAALAPCQGLGLRRRTLISSSCSSPTTSFRGDSFQRP

SEQ ID NO: 1024573 - protein, 720 aa, Homo sapiens
MEEAEELLLEGKKALQLAREPRLGLDLGWNPSGEGCTQGLKDVPPEPTRDILALKSLPRGLALGPSLAKEQRLGVWCVGDPLQPGLLWGPLEEESASKEKGEGVKPRQEENLSLGPWGDVCACEQSSGWTSLVQRGRLESEGNVAPVRISERLHLQVYQLVLPGSELLLWPQPSSEGPSLTQPGLDKEAAVAVVTEVESAVQQEVASPGEDAAEPCIDPGSQSPSGIQAENMVSPGLKFPTQDRISKDSQPLGPLLQDGDVDEECPAQAQMPPELQSNSATQQDPDGSGASFSSSARGTQPHGYLAKKLHSPSDQCPPRAKTPEPGAQQSGFPTLSRSPPGPAGSSPKQGRRYRCGECGKAFLQLCHLKKHAFVHTGHKPFLCTECGKSYSSEESFKAHMLGHRGVRPFPCPQCDKAYGTQRDLKEHQVVHSGARPFACDQCGKAFARRPSLRLHRKTHQVPAAPAPCPCPVCGRPLANQGSLRNHMRLHTGEKPFLCPHCGRAFRQRGNLRGHLRLHTGERPYRCPHCADAFPQLPELRRHLISHTGEAHLCPVCGKALRDPHTLRAHERLHSGERPFPCPQCGRAYTLATKLRRHLKSHLEDKPYRCPTCGMGYTLPQSLRRHQLSHRPEAPCSPPSVPSAASEPTVVLLQAEPQLLDTHREEEVSPARDVVEVTISESQEKCFVVPEEPDAAPSLVLIHKDMGLGAWAEVVEVEMGT

SEQ ID NO: 1024574 - protein, 617 aa, Homo sapiens
MEEAEELLLEGKKALQLAREPRLGLDLGWNPSGEGCTQGLKDVPPEPTRDILALKSLPRGLALGPSLAKEQRLGVWCVGDPLQPGLLWGPLEEESASKEKGEGVKPRQEENLSLGPWGDVCACEQSSGWTSLVQRGRLESEGNVAPVRISERLHLQVYQLVLPGSELLLWPQPSSEGPSLTQPGLDKEAAVAVVTEVESAVQQEVASPGEDAAEPCIDPGSQSPSGIQAENMVSPGLKFPTQDRISKDSQPLGPLLQDGDVDEECPAQAQMPPELQSNSATQQDPDGSGASFSSSARGTQPHGYLAKKLHSPSDQCPPRAKTPEPGAQQSGFPTLSRSPPGPAGSSPKQGRRYRCGECGKAFLQLCHLKKHAFVHTGHKPFLCTECGKSYSSEESFKAHMLGHRGVRPFPCPQCDKAYGTQRDLKEHQVVHSGARPFACDQCGKAFARRPSLRLHRKTHQVPAAPAPCPCPVCGRPLANQGSLRNHMRLHTGEKPFLCPHCGRAFRQRGNLRGHLRLHTGERPYRCPHCADAFPQLPELRRHLISHTGEAHLCPVCGKALRDPHTLRAHERLHSGERPFPCPQCGRAYTLATKLRRHLKSHMGLGAWAEVVEVEMGT

SEQ ID NO: 1024575 - protein, 615 aa, Homo sapiens
MVLFQNLSLGPWGDVCACEQSSGWTSLVQRGRLESEGNVAPVRISERLHLQVYQLVLPGSELLLWPQPSSEGPSLTQPGLDKEAAVAVVTEVESAVQQEVASPGEDAAEPCIDPGSQSPSGIQAENMVSPGLKFPTQDRISKDSQPLGPLLQDGDVDEECPAQAQMPPELQSNSATQQDPDGSGASFSSSARGTQPHGYLAKKLHSPSDQCPPRAKTPEPGAQQSGFPTLSRSPPGPAGSSPKQGRRYRCGECGKAFLQLCHLKKHAFVHTGHKPFLCTECGKSYSSEESFKAHMLGHRGVRPFPCPQCDKAYGTQRDLKEHQVVHSGARPFACDQCGKAFARRPSLRLHRKTHQVPAAPAPCPCPVCGRPLANQGSLRNHMRLHTGEKPFLCPHCGRAFRQRGNLRGHLRLHTGERPYRCPHCADAFPQLPELRRHLISHTGEAHLCPVCGKALRDPHTLRAHERLHSGERPFPCPQCGRAYTLATKLRRHLKSHLEDKPYRCPTCGMGYTLPQSLRRHQLSHRPEAPCSPPSVPSAASEPTVVLLQAEPQLLDTHREEEVSPARDVVEVTISESQEKCFVVPEEPDAAPSLVLIHKDMGLGAWAEVVEVEMGT

SEQ ID NO: 1024576 - protein, 720 aa, Homo sapiens; identical to SEQ ID NO: 1024573

SEQ ID NO: 1024577 - protein, 747 aa, Homo sapiens
MEEAEELLLEGKKALQLAREPRLGLDLGWNPSGEGCTQGLKDVPPEPTRDILALKSLPRGLALGPSLAKEQRLGVWCVGDPLQPGLLWGPLEEESASNVMNVLLMADCKSHLCMCCDATLSLRCHTGGRLLCRHVDAFKFLCCELLLVYILVCSAWTDVDVEHCCAPSSVIMDDGFNLANVVPGLVLLAMGSELLLWPQPSSEGPSLTQPGLDKEAAVAVVTEVESAVQQEVASPGEDAAEPCIDPGSQSPSGIQAENMVSPGLKFPTQDRISKDSQPLGPLLQDGDVDEECPAQAQMPPELQSNSATQQDPDGSGASFSSSARGTQPHGYLAKKLHSPSDQCPPRAKTPEPGAQQSGFPTLSRSPPGPAGSSPKQGRRYRCGECGKAFLQLCHLKKHAFVHTGHKPFLCTECGKSYSSEESFKAHMLGHRGVRPFPCPQCDKAYGTQRDLKEHQVVHSGARPFACDQCGKAFARRPSLRLHRKTHQVPAAPAPCPCPVCGRPLANQGSLRNHMRLHTGEKPFLCPHCGRAFRQRGNLRGHLRLHTGERPYRCPHCADAFPQLPELRRHLISHTGEAHLCPVCGKALRDPHTLRAHERLHSGERPFPCPQCGRAYTLATKLRRHLKSHLEDKPYRCPTCGMGYTLPQSLRRHQLSHRPEAPCSPPSVPSAASEPTVVLLQAEPQLLDTHREEEVSPARDVVEVTISESQEKCFVVPEEPDAAPSLVLIHKDMGLGAWAEVVEVEMGT

SEQ ID NO: 1024578 - protein, 213 aa, Homo sapiens
MAYHSFLVEPISCHAWNKDRTQIAICPNNHEVHIYEKSGAKWTKVHELKEHNGQVTGIDWAPESNLYCDLRHRPERLRVDAEGPHMEAHAGHPADQPGLPAACAWAPNENKFACGQRALVVISICYYEQENDWWVLQAHSRSPSCSTVLSLDLAPQQCASWLPAPVTSRCRIFSAYIKEVEERLGPTRGVQDAFGELMSESEVVAVVHGAVST

SEQ ID NO: 1024579 - protein, 113 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRGCPLRALGPPTRTSLQ

SEQ ID NO: 1024580 - protein, 118 aa, Homo sapiens
ITPWIRQASAGFLQHPPYQQCPFLPPTGALLRKCTFTLAYPQTKRTKIKTPGGENKTLYNLEANNFWLSPCLSYQYKGAVSVRWVEPESCPQFGVELETENLCWAHTRATGLGNLLVS

SEQ ID NO: 1024581 - protein, 707 aa, Homo sapiens
MTTFKEAMTFKDVAVVFTEEELGLLDLAQRKLYRDVMLENFRNLLSVGHQAFHRDTFHFLREEKIWMMKTAIQREGNSGDKIQTEMETVSEAGTHQEWSFQQIWEKIASDLTRSQDLVINSSQFSKEGDFPCQTEAGLSVIHTRQKSSQGNGYKPSFSDVSHFDFHQQLHSGEKSHTCDECGKNFCYISALRIHQRVHMGEKCYKCDVCGKEFSQSSHLQTHQRVHTGEKPFKCVECGKGFSRRSALNVHHKLHTGEKPYNCEECGKAFIHDSQLQEHQRIHTGEKPFKCDICGKSFCGRSRLNRHSMVHTAEKPFRCDTCDKSFRQRSALNSHRMIHTGEKPYKCEECGKGFICRRDLYTHHMVHTGEKPYNCKECGKSFRWASCLLKHQRVHSGEKPFKCEECGKGFYTNSQCYSHQRSHSGEKPYKCVECGKGYKRRLDLDFHQRVHTGEKLYNCKECGKSFSRAPCLLKHERLHSGEKPFQCEECGKRFTQNSHLHSHQRVHTGEKPYKCEKCGKGYNSKFNLDMHQKVHTGERPYNCKECGKSFGWASCLLKHQRLRSGEKPFKCEECGKRFTQNSQLHSHQRVHTGEKPYKCDECGKGFSWSSTRLTHQRRHSRETPLKCEQHGKNIVQNSFSKVQEKVHSVEKPYKCEDCGKGYNRRLNLDMHQRVHMGEKTWKCRECDMCFSQASSLRLHQNVHVGEKP

SEQ ID NO: 1024582 - protein, 133 aa, Homo sapiens
MAKVQVNNVVVLDNPSPFYNPFQFEITFECIEDLSEDLEWKIIYVGSAESEEYDQVLDSVLVGPVPAGRHMFVFQADAPNPGLIPDADAVGVTVVLITCTYRGQEFIRVGYYVNNEYTETELRENPPVKPRLF

SEQ ID NO: 1024583 - protein, 119 aa, Homo sapiens
FSTYFFNPLFFLFSSSPYFLEEENLSENSDKFGIILRNELMKLPSDFVTAVRGKGLLNAIVIKETKDFYALKVFLLLLDNGLLANPTHGYIIIFAPPLVINDDELRESIEIINKTILSF

SEQ ID NO: 1024584 - protein, 119 aa, Homo sapiens; identical to SEQ ID NO: 1024583

SEQ ID NO: 1024585 - protein, 69 aa, Homo sapiens
GTRFLSANSLTLGTLRKSRNFHEGTSISCDSNYSQNVSDISSSTVSLEMLDFQFHGRILMDGMFFSGRH

SEQ ID NO: 1024586 - protein, 118 aa, Homo sapiens
MALSPADKTNVKAAWGKVGTRWRMVSEALEVCSSFPTTKDLLPTLQYLSHGSAQVKGHGKKVADALTNAVANVDDMPNALSALRDLHEEQSFGVGPGSNFQGFLSHLPCLVNPGRQPP

SEQ ID NO: 1024587 - protein, 257 aa, Homo sapiens
MICLTENFRTDVKDFVTLLTANTCDIRKSILYLQFWIRSGGGVLEERPLTLYRGNSRNVQLVCSEHGLDNKIYPKNTKKKRVDLPKCDSGCAETLFGLKNIFSPSEDLFSFLKHKITMKEEWHKFIQLLTEFQMRNVDFLYSNLEFILPLPVDTIPETKNFCGPSVTVDASAATKSMNCLARKHSEREQPLKKSQKKKQKKTLVILDDSDLFDTDLDFPDQSISLSSVSSSSNAEESKTGDEESKARDQGKQSRDKE

SEQ ID NO: 1024588 - protein, 178 aa, Homo sapiens
SRPRILQSLYSVGFVGIRDKNTSSYSFCHDGRTPDKGFESNEKLLIHPCYWLGLNLNRNALAPEEAEEINDEYDINIISDNSAIRNKTIGQITTHLDQIPIGNEGATEFEQWCLDALRIVFASHLTDIKSHPNGNAVQRRDIIGTNGGKSDFWKRVLEDYKTRQVVFDGKNFEELGPS

SEQ ID NO: 1024589 - protein, 107 aa, Homo sapiens
NAGIKGLPCACKPRPNFCNFLLKDGVFTRVPGWCRNSRALRWSCPASALPKVPGIIGVSPPTPWQRGSIFKFSFHLTQLSTLVLGEYDLAEKSRVSAHYIVLNFPRL

SEQ ID NO: 1024590 - protein, 98 aa, Homo sapiens
LQGAWLRRPIAAGIKACVSTEAPPIIFATPTLTSDSTVYDYAGKNKVPELQKFFQKADGVPVYLKRLPDQMLYRTTMALTVGGTIYCIALYNSQPKNK

SEQ ID NO: 1024591 - protein, 258 aa, Homo sapiens
MSGAPVTVIPRPEAPRCAIPLAIICRWYADAHSISPLTASPGQLMTPPHGVLYARTHYVPRWSTLHVSMGPGLGLSPDNVALEVANAIIGHYDCTYGGGVHLSSPLASGAVANKLCQSFQTFSICYAETGLLGAHFVCDRMKIDDMMFVLQGQWMRLCTSATESEVARGKNILRNALVSHLDGTTPVCEDIGRSLLTYGRRIPLAEWESRIAEVDASVVREICSKYIYDQCPAVAGYGPIEQLPDYNRIRSGMFWLRF

SEQ ID NO: 1024592 - protein, 245 aa, Homo sapiens
MRLLAVRSQRDELIYHIIAHVRIAVEGPGLGLSPDNVALEVANAIIGHYDCTYGGGVHLSSPLASGAVANKLCQSFQTFSICYAETGLLGAHFVCDRMKIDDMMFVLQGQWMRLCTSATESEVARGKNILRNALVSHLDGTTPVCEDIGRSLLTYGRRIPLAEWESRIAEVDASVVREICSKYIYDQCPAVAGWESRIAEVDASVVREICSKYIYDQCPAVAGYGPIEQLPDYNRIRSGMFWLRF

SEQ ID NO: 1024593 - protein, 212 aa, Homo sapiens
SGSGRSADMEEDLFQLRQLPVVKFRRTGESARSEDDTASGEHEVQIEGVHVGLEAVELDDGAAVPKEFANPTDDTFMVEDAVEAIGFGKFQWKLSVLTGLAWMADAMEMMILSILAPQLHCEWRLPSWQVALLTSVVFVGMMSSSTLWGNISDQYGRENRADDQRAVDSVPMASLVHMRRVQLDPGAPGPGGLRDTEEFPKSVTLYAEYLPM

SEQ ID NO: 1024594 - protein, 188 aa, Homo sapiens
NLQAIADAEQRGEMPLKDAKNKLEGLEDALQKAKQDLALLKEYQELMNVKLALDVEIATYRKLLEGEECRLNGEGVGQVNISVVQSTVSSGYGGASGVGSGLGLGGGSSNTYGSGLGVGGFSGRAIGGGLSPVGGGSSTIKYTTTSPSRKSNTKEQLAPGPINLSGPSLARRALSFRLPCPLLASSLP

SEQ ID NO: 1024595 - protein, 31 aa, Homo sapiens
MKVDSSQEANAEVMREMTRKLYSQYEGKLQE

SEQ ID NO: 1024596 - protein, 127 aa, Homo sapiens
FFVFLRQGLTLSLRLECSGVNTAHYSLDLLDSSNPPTSAIQVAQIMCACHHIWLTFLYFVEKGSHFVAHAGLKLHVLNVILEIHLAFQSVGITAMSHHASQSSFSYSSCYIFFFKINLFVSQDGQGD

SEQ ID NO: 1024597 - protein, 519 aa, Homo sapiens
PSPASLLRAEGTRRMVVAKEYGRPGAAAHACNPSTSGRPRGADDLRPCNTCQHQHLTRNRRKQAGHTLTTLVQVIGVSGSWVLEITLSGRADGVLGWRLEVEESRHRQKLEGRVSRAGQKGAPRHGPQGSTLLMGPGPERGAPASSHSERADRRGFGLVFPDEIAGTFREAGEQAQQTSDVVLPVSCECAWPLRGVWDGESGEGNPTRPSPCCSWQLDLGNCASTLWRGLPLCWLQIRGAMGRDPPVQAGAHLPDPGVGERGAWEDARCLRAPGQQRGTDSPLGGDGPARGPCAVCLHRERKGSRDHGYVGHLKVESRSLETGAVGTRRSFLAELGWGSCSPPGAPDATPWLIPGEEAAESELMTVDVVAAGSQRMVGPGTQVTLGDVVTVTAVCGPLGSKQRESQETEGNLSLRLLILVTLLALDTSAISYQGYPIPGELESGLMGRKRGQRELRAVRDVPAPTLPTSSLGPFLPPSPTHSRVAPFTVSPGFNSEAGEQGLTSVCRRLSEWPARAGSS

SEQ ID NO: 1024598 - protein, 519 aa, Homo sapiens; identical to SEQ ID NO: 1024597

SEQ ID NO: 1024599 - protein, 374 aa, Homo sapiens
ADSRSLALLGPPDALPTRVSGTLGPNARLLALTLRFTPAGALAPTLPLTRAHTPPRALRSGSSPAPREGAGTAAESAEGPRGLPMADLSFIEDTVAFPEKEEDEEEEEEGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAAFQ

SEQ ID NO: 1024600 - protein, 153 aa, Homo sapiens
MADLSFIEDTVAFPEKEEDEEEEEEGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMEVRITNHLVKILFSE

SEQ ID NO: 1024601 - protein, 130 aa, Homo sapiens
MNSTPRNAQAPSHRECFLPSVARTPSVTKVTPAKKITFLKRGDPRFAGVRLAVHQRAFKTFSALMDELSQRVPLSFGVRSVTTPRGLHSLSALEQWKMEAVTLPDKKPPRPPVDQAGTGEKPTVVGDVAT

SEQ ID NO: 1024602 - protein, 79 aa, Homo sapiens
LPFSKSPIGAPSRLTVSLHQFQRGPQQTQEHRWVSPTQFLPLGSLFSEWSVCGEDSLSALGIGGLWVKRMKAIQSEDVA

SEQ ID NO: 1024603 - protein, 172 aa, Homo sapiens
MEMRSPLLAGGSPPQPVVPAHTDKSGAPPVRSIYDDISSPGLGSTPLTSRRQPNISVMQSPLVGSYIYSWEQGQSMFSPSKVSGQPAKDDIILLASWILCYTQGASFDFRRYTSNDSLGDCIWGVLKHSVFLHIITIWPSMGTFFNHVMVVHTGKKGAYIVIKLKLWGGERL

SEQ ID NO: 1024604 - protein, 105 aa, Homo sapiens
QSEWLKKYLNKVQTPSSACTGSKLGLTEATATSAARLQEPPPGHTGFLPDAAQLCLGHRVALQVTGQLAKLHSPLSSLDLCDNVYRGSGPWYASDLASCTTVPRP

SEQ ID NO: 1024605 - protein, 69 aa, Homo sapiens
GASGRFLGEGMSVLRPEGELARELRAACAEAQWSAPPTIQNAASRLVWEMGGTEAGGLGAWHMGPHHLV

SEQ ID NO: 1024606 - protein, 189 aa, Homo sapiens
MFGQDLLLFKMAGHALRQPIGKTPFWGVDPLCCVWEGYPWGFSEPGVWGPPALQGWDARESLFGRRRASQGPKYEIWTNPLHASQGERVAARKRWGLAQHVRCQCLWGHGTAGRERCSQDSASPASSTGLPEGSEPESSCCPRTPEDGVDSASPSAQIGAERKAGGSLGEDPGLCIDGAGLGSPEQGGR

SEQ ID NO: 1024607 - protein, 72 aa, Homo sapiens
ALAGAGAAVIAMVHYLMVLSANWAYVKDACRMQKYEDIKSKEEQELHDIHSTRSKEQLNGSHECIFLFLLTI

SEQ ID NO: 1024608 - protein, 86 aa, Homo sapiens
ALAGAGAAVIAMVHYLMVLSANWAYVKDACRMQKYEDIKSRRGFPIQNIHYIARKSGSRQPDECMLDCSLYVLSIALVLNYVYLIA

SEQ ID NO: 1024609 - protein, 110 aa, Homo sapiens
LHFFKPVLLLWHFDKMVRNQLLTGKRVHVPPCAGASVPDMWISMNGNVFLHVSAYSEFQNFENAKYFHGHLAFGLPRDEIERDFEIRIVFNQPSTCATMMYNKEFVAEEK

SEQ ID NO: 1024610 - protein, 169 aa, Homo sapiens
MSKNTVSSARFRKVDVDEYDENKFVDEEDGGDGQAGPDEGEVDSCLRQGNMTAALQAALKNPPFNTKSQAVKDRAGSIVLKVLISFTANDIEKEVQSLDKNGVDLLMKYIYKGFESPSDNKQCYVTAMDEKAAAGRIGSVRVLAKKTVSGQWCLGGECWKQKKQPLPCG

SEQ ID NO: 1024611 - protein, 330 aa, Homo sapiens
NSRFSKWNTTLVTQVSGVQRALKFFQKLRIKKAPKWPKFLGCIKKLSTDSKPVFKERIKTATCLCGNAPEPGKTTGEVVSGVVIKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKDFYDKIEAKKWQERKEALESVEVLIINPILEAGDYADLVKALKKVVGKDTYVLLELGIL

SEQ ID NO: 1024612 - protein, 37 aa, Homo sapiens
MEDDAPVIYGLEFQARALTPQTAETDAIRFLVGTHFL

SEQ ID NO: 1024613 - protein, 108 aa, Homo sapiens
IPGPPRKSLYSQEFPPWAHEPRDGNPKMEGGLRNKFTETEDQKQEKGQRVAERRSGGNNVTLHLGERGGAQGRRDSGGSGKGARRRIWDLAGVTGTQNKGHKEAGEGL

SEQ ID NO: 1024614 - protein, 301 aa, Homo sapiens
MPPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDVILHVLPLHHVHGVVNALLCPLWVGATCVDDGLSSALSRFGKSSYSSEKAADQCLYGSGYQYTPK

SEQ ID NO: 1024615 - protein, 301 aa, Homo sapiens; identical to SEQ ID NO: 1024614

SEQ ID NO: 1024616 - protein, 123 aa, Homo sapiens
FRPDSRPRGTRPEPGPTPARARRRTRKSCGEADPAPWPRPSRRWVTGLVHKWAWTKDDVILHVLPLHHVHGVVNALLCPLWVGATCVDDGLSSALSRFGKSSYSSEKAADQCLYGSGYQYSPK

SEQ ID NO: 1024617 - protein, 63 aa, Homo sapiens
RHSNLQDLRRQPRPGQAALGHTFPETHDMSLEETSFGFHSEDQRLLRLLGTFIKNVFLLFYQE

SEQ ID NO: 1024618 - protein, 63 aa, Homo sapiens; identical to SEQ ID NO: 1024617

SEQ ID NO: 1024619 - protein, 469 aa, Homo sapiens
GSSRSGNWAQVPAAALNPARAVIGRRPRAAAEAGDPKEAGAGCMGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 1024620 - protein, 464 aa, Homo sapiens
TEGVRGGRGGACWGGGPEAGPGEAAWKRRSGAKEAEKKALPGARKWVRTRQNRLHSNSRGTVHWAWTRRRDPADAVIGCMSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 1024621 - protein, 428 aa, Homo sapiens
MAWRWRAARVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 1024622 - protein, 502 aa, Homo sapiens
GSSRSGNWAQVPAAALNPARAVIGRRPRAAAEAGDPKEAGAGCMGRRRQRVDPAAGARAGALPEAIAALSRSLPSGPSPEIFRRAKFDRPEAVTLSRRAGGPGGVPGPRRELGRLRCLPAFYFPQTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 1024623 - protein, 538 aa, Homo sapiens
GSSRSGNWAQVPAAALNPARAVIGRRPRAAAEAGDPKEAGAGCMGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQFLEREPPKTWTWPTQSACTPSALLGWVPEPSGMICGWYVSSQVCCRVTGQLPLDPGGASACSLLSPFRALLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 1024624 - protein, 208 aa, Homo sapiens [sequence omitted]

SEQ ID NO: 1024625 - protein, 469 aa, Homo sapiens; identical to SEQ ID NO: 1024619

SEQ ID NO: 1024626 - protein, 466 aa, Homo sapiens
LNKAQSCSAISPTPPAKFCGAAVPHLLLPSPWLPPPCSSAALPGARKWVRTRQNRLHSNSRGTVHWAWTRRRDPADAVIGCMSGQRGDWTSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 1024627 - protein, 385 aa, Homo sapiens [sequence omitted]

SEQ ID NO: 1024628 - protein, 374 aa, Homo sapiens
MGTGLGSAVIGPPRSGSSSSVCSRHSLRATPWHRSPWGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 1024629 - protein, 436 aa, Homo sapiens
GSSRSGNWAQVPAAALNPARAVIGRRPRAAAEAGDPKEAGAGCMGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKLLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 1024630 - protein, 208 aa, Homo sapiens [sequence omitted]

SEQ ID NO: 1024631 - protein, 286 aa, Homo sapiens
QVPNAADSAGATSLYRWYQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALLPFLVGGRRYLALGSDFSFTQIYQWDEGRQKFVRFQELAVQAPRAFCYMPAGDAQATPVPQLRRGQTLVSRTHCGWISVPRGCEASGLLRLATGGWVGASVSTTLCLCEDKRPSCIHARVFRSRTSDVHGAPPWDWPQEDVHHHCNQALISREPHEKT

SEQ ID NO: 1024632 - protein, 400 aa, Homo sapiens
LAFPAVSAEPFLYSSDLYLALAQPGVSACTILKWDYVERQLRDYDRIPAPSAVHCKPMVVDSQLYVVVAQLFGGSYIYHWDPNTTRFTRLQDIDPQRVRKPNDLEAFRIDGDWYFAVADSSKAGATSLYRWYQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALLPFLVGGRRYLALGSDFSFTQIYQWDEGRQKFVRFQELAVQAPRAFCYMPAGDAQATPVPQLRRGQTLVSRTHCGWISVPRGCEASGLLRLATGGWVGASVSTTLCLCEDKRPSCIHARVFRSRTSDVHGAPPWDWPQEDVHHHCNQALISREPHEKT

SEQ ID NO: 1024633 - protein, 124 aa, Homo sapiens
GNQLIPPNAQVKKATVFFNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQ

SEQ ID NO: 1024634 - protein, 168 aa, Homo sapiens
GNQLIPPNAQVKKATVFFNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVHIFLCQIAILRGPVPSLFTVRVKGHPFFNPALVGFRVVAKDDAGF

SEQ ID NO: 1024635 - protein, 136 aa, Homo sapiens
MRSSYETLGKERTRNAGDQRPSRETCPAGASSRHRDAPGPGTASLHPCESGANPGGEFLPAAQQQSPLRPALSPSLPLSSSCARGTRALESAANAQVLAAPSPCRYSHSATAQRGSYLRNTADFVYLVLQSHLSEA

SEQ ID NO: 1024636 - protein, 131 aa, Homo sapiens
MWLPCIFFNFISSLAMYIHPSLSHALCRAFWFQNVPCAFLLWSSLNRMPFLPCLPVDRNILCIGELALTTIFLDAELLLFPSVFAQLCLCTVDFWLGHVDCLLHEFASFLRTMSVLFILEFSVPSRVHSTG

SEQ ID NO: 1024637 - protein, 104 aa, Homo sapiens
MSHTILLVQPTKRPEGRTYADYESVNECMEGVCKMYEEHLKGMNPNSPSITYDISQLFDFIDDLADLSCLVYRADTQTYQPYNKDWIKEKIYVLLRRQAQQAGK

SEQ ID NO: 1024638 - protein, 106 aa, Homo sapiens
SEARVTAAVSAAAVAKRVWRDVSHHFAGTAYQEARRRTYADYESVNECMEGVCKMYEEHLDFIDDLADLSCLVYRADTQTYQPYNKDWIKEKIYVLLRRQAQQAGK

SEQ ID NO: 1024639 - protein, 279 aa, Homo sapiens
KLEANMESVSCSAAAVRTGDMESQRDLSLVPERLQRREQERQLEVERRKQKRQNQEVEKENSHFFVATFARERAAVEELLERAESDERLEEAASRLQGLQKLINDSAFIFLAALRPAAKDNEALPGLQAALAERAPGGCKPKEDVFAFQDPGERMLVRFTKVEGGSWHPHRKLKAYTTPPNDQEGGNRDLGHSCVLRILQNMESQSSMEKETPGEVGNKRRQYLYGPELSNCTGQTCMEHRNHPGANKGTQLQLKLRSRMIHTVYMAHDETCPSQGMQR

SEQ ID NO: 1024640 - protein, 218 aa, Homo sapiens
GPLVARRRVLPLLSLTVFSLSFPVCAPCLCLHSPVRDVGSSRACMASCHPSVPLVRPRTVMPPSLLAREFECGLHLELLFLDHWKDRYLPDTLLFGGYVASCGRGQCYWLTSDLSQVRHDFLAHVLLGAAAFECITYQSFLEYSGRWWYGLENGHLARRPGSAAGTRDCPPRPPSRALSPSLVLKVPDVLLLTFCGVPACVLNAKATPRLEACVPEHA

SEQ ID NO: 1024641 - protein, 111 aa, Homo sapiens
LVEDLVTMFEMPPKDLEILHKLVDKPAAEFERIDSILKNVPLWVKGYPTAPHATDKSFGKEESVDVAAFLVVSFKEISRATLTFSNHHTDHSAAINSEARLSSSNKDSLKT

SEQ ID NO: 1024642 - protein, 229 aa, Homo sapiens
HEGGGRHWVSASGKRFSCLVPSSRPSGRASPPATAAAVLPVWPRVGLHWLWIHPHLLKMHPDLSPHLHTEECNVLINLLKECHKNHNILKFFGYCNDVDRELRKCLKNEYVENRTKSREDGIEYARRKFLILSEESETNNGIYTLMPGLREDPKTLGGYHERILAYLVVHNSFEWKVTCEKIEAWRNVKTLDSEYGGQALSNWLPLRRKPDFHVNPIATTSISEELSPQ

SEQ ID NO: 1024643 - protein, 116 aa, Homo sapiens
MSAPGRMPHTPTVSYQRAELLRGHAALLPAPCPFLALSLNLQNIDPCRSPTSQEEQRKTIPPACPCGPVFLGSLSGVGSLNPFSAPRLPHQGRLEGPPSGFCICASKHHCRWSLMT

SEQ ID NO: 1024644 - protein, 49 aa, Homo sapiens
MALQVLERAWPGKFVQVPRSRLVLCFLVGVDDRFQGGGAAACLTPLAPD

SEQ ID NO: 1024645 - protein, 196 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGKLCLYKSRSCL

SEQ ID NO: 1024646 - protein, 205 aa, Homo sapiens
MAWQLLQPAMRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGKLCLYKSRSCL

SEQ ID NO: 1024647 - protein, 196 aa, Homo sapiens; identical to SEQ ID NO: 1024645

SEQ ID NO: 1024648 - protein, 219 aa, Homo sapiens
SGAGEQGSEQDRSLIPQQLLQPAMRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGKLCLYKSRSCL

SEQ ID NO: 1024649 - protein, 221 aa, Homo sapiens
RGCNLMFLARDIDLYLSTFQLLQPAMRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGKLCLYKSRSCL

SEQ ID NO: 1024650 - protein, 95 aa, Homo sapiens
GPLPLSPRPSSPLTVSGRTPDVRRRHTHLTRHTSYTNTISSHSHTGTCPSAPTFRHQSTLYIQMFMAALFTIAKNGKQLKCPSTIEWKTNCGMLI

SEQ ID NO: 1024651 - protein, 134 aa, Homo sapiens
VIQMTPRRTVYGSCLRRAENLEDRPKLSPSFGGMVPSKSRESVASEGSNQTSGYQSGYHSDDTDTTVYSSEEAELLKLIEIGVQTGSTAQILQPDSGTTLSSPTHSHPATHQYFSYLASTPVNLIGFVHSLNDY

SEQ ID NO: 1024652 - protein, 105 aa, Homo sapiens
VIQMTPRRTVYGSCLRRAENLEDRPKLSPSFGGMVPSKSRESVASEGSNQTSGYQSGYHSDDTDTTVYSSEEAELLKLIEIGVQTGSTAQILQPDSGTTLSSPPV

SEQ ID NO: 1024653 - protein, 123 aa, Homo sapiens
VIQMTPRRTVYGSCLRRAENLEDRPKLSPSFGGMVPSKSRESVASEGSNQTSGYQSGYHSDDTDTTVYSSEEAELLKLMLILYSEYHKERTFSSRLPAVLKSSDCTNQLLVSSGMNTLISVLM

SEQ ID NO: 1024654 - protein, 108 aa, Homo sapiens
KSLWFLKVLPAGSYFQSFPWRLLVCFRWGYCFSLWLLPSLLLSLVSSSSISLSTHLLLCTPDPSRRGESCGEGGVSVHYPGLGFPINAHSFVLFNKRTKSKKPQPTAF

SEQ ID NO: 1024655 - protein, 280 aa, Homo sapiens
MTRHGKNCTAGGVYTYHEKKKDTAASGYGTQNIRLSRMREEFDVVVFSLSFALPDPVVTPDGYLYEREAILEYILHQKKEIARQMKAYEKQRGTRREEQKELQRAASQDHVRGFLEKESAIVSRPLNPFTAKAFSGTSPDDVQLGPSVGPPSKDKGQSAAQFLDPVADARSKATKLEKPSRTVTCPCQGSPCALFGPDAVALSHRRQLRGPAVGLITLQERYVCAGDPRQLSKAPLRCAGGLWAGVTLECVEKLSEALGACDEDTFRRTHLLAGAGRAGE

SEQ ID NO: 1024656 - protein, 264 aa, Homo sapiens
MTRHGKNCTAGGVYTYHEKKKDTAASGYGTQNIDEPCHDPVVTPDGYLYEREAILEYILHQKKEIARQMKAYEKQRGTRREEQKELQRAASQDHVRGFLEKESAIVSRPLNPFTAKAFSGTSPDDVQLGPSVGPPSKDKGQSAAQFLDPVADARSKATKLEKPSRTVTCPCQGSPCALFGPDAVALSHRRQLRGPAVGLITLQERYVCAGDPRQLSKAPLRCAGGLWAGVTLECVEKLSEAWGPVTEDTFRRTHLLAGAGRAGE

SEQ ID NO: 1024657 - protein, 273 aa, Homo sapiens
LCDALARDRTRLSPTRTTGPGFHRGPGPPARLAAPWWTLNTPTFPALPGMSQMFMKLATYLRMIKLEFDVEELTSTSVEHIIVNPNAAYDKFKDNESGDQRDLISHDRIGKTKRTGYESGEYEMLGGGSGSDGDTPAKVPGFLHEVQELTTEVEKIKTTVKESATEEKLTPVLLAKQLAALKQQLVASHLEKLLGPDAAINLTDPGALANRLLLQLEATKNSGGSGGKTTGTPPDSSLTYLHSRPEQDKFSAAKVAELEKRLHRAGDSCNVVI

SEQ ID NO: 1024658 - protein, 169 aa, Homo sapiens
PEGGRGSWRTVFGSGGGAMTTLRAFTCDDLFRFNNINFDSLTETYGIPFYLQYLATARVFHCCRGTWWRLNGYIMGKAEGSSAREECTGTSPALSVAPRISTPLLWLLKLMESLEEIPDKNGVHFWWDLLCKEYLTQVCSYHVQGSVGSQCYIRTVIEYLSGQGNGGAP

SEQ ID NO: 1024659 - protein, 66 aa, Homo sapiens
QSTGNVQAFSTQSGMNLEWSQKCFEDNNWDYIQICQAFTHLKAKGEIPEVDIHEVIVVMPQKQSPL

SEQ ID NO: 1024660 - protein, 191 aa, Homo sapiens
RLVRLEALEIATAVTEFLRPRPLTGRRRWGAAGFTLRGVRKHQEKGCSHLEEKMLEQHTIFLNIIICLWMTMKFKDTDCLFIPLDIVIVYNTDNTMMIGSEDLEVPEAGFRHVAQAGLELDASNPPALTCQRAGITGSAGRRDGSNAMDLHVLQSVGGLGLCSESKYHPGWRWEVMGGPDRCLLLLAARRE

SEQ ID NO: 1024661 - protein, 135 aa, Homo sapiens
RLVRLEALEIATAVTEFLRPRPRREGGVGGRLGLPFESPCENRDTCPVEKGDAKAENARKDMASLNCGTCSCSCGVDHGNRSAGRRDGSNAMDLHVLQSVGGLGLCSESKYHPGWRWEVMGGPDRCLLLLAARRE

SEQ ID NO: 1024662 - protein, 404 aa, Homo sapiens [sequence omitted]

SEQ ID NO: 1024663 - protein, 74 aa, Homo sapiens
VTRWGRIQVPGVIGAQPVYQSVHPPKETPMTLPGTVPGPMLLQGGGSISAVRNGHWIHVFICKNGCLNFLTSYW

SEQ ID NO: 1024664 - protein, 123 aa, Homo sapiens
AGHLGCRDHYFGCRHRNPSVELCVGRITRRLPRPKGREQERHHAGEVTGHERTEGQAGAIGRELSGVEVTADRHRFGQPEMGSIRDRQRYPRDFAALNSFCASGQPRFQGPRQFPTFRVSRAS

SEQ ID NO: 1024665 - protein, 372 aa, Homo sapiens
GSEAWVAAQGEAGMSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNYILNADGPAPLELPNSWLWDIIDEFIYQFQSFSQYRCKTGKKSEEEIDFLRSNPKIWNVHSVLNVLHSLVDKSNIQPTVGGIHKAEVTLESVVGSNGRTPSTKCLVTSAGRGSPGCTPCYGDYYQGIKVLENIELNKKSMYSRVPECQVTKKYYVGFAYLKMRDYQEPTGVFANILRLHPEEQQSMFQRTTYKY

SEQ ID NO: 1024666 - protein, 335 aa, Homo sapiens
GSEAWVAAQGEAGMSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPRLKPLLHRLAMTGTYMPKSVGDLPWSRGLNPILWDIIDEFIYQFQSFSQYRCKTGKKSEEEIDFLRSNPKIWNVHSVLNVLHSLVDKSNIQPTVGGIHKAEVTHESVVGSIGRTPSTKCLVTSAGRGSPACTPCYGDYYQGIKVLENIELNKKSMYSRVPECQVTKKYYVGFAYLKMRRYQDAIRRLRQHPPSTSRGAQSMFQRTTYKY

SEQ ID NO: 1024667 - protein, 447 aa, Homo sapiens
MAEGEGYFAMSEDELACSPYIPLGGDFGGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 1024668 - protein, 466 aa, Homo sapiens
MHQRYFWTDQGQVALGGHYMAEGEGYFAMSEDELACSPYIPLGGDFGGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKALQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 1024669 - protein, 114 aa, Homo sapiens
MAVAGGGKGEILLHWPPKLGGELGGDARPSREPGLRATQPSVQSSLASGYQLPAALSSAGWHSARGKAEQVCEAKCLRGAPRGENPEEKETARIGPGKRINRSSLYMKKKKYRP

SEQ ID NO: 1024670 - protein, 282 aa, Homo sapiens
ESDRAVRSGAPHADGSREAVFCACIWRWRVGGRGRSCCTGRPSWGASSVVTRGPHVTERLQSDAAFGAVVTRVWLPAPRCPELGGLAFGPGKSGAGKGSGAREPRPCQQRLTDLGDRRRTAQGVPASFLHTPTCLGTQRPPGMGKQGRLGFQVRQSHQERWKPSPESLQENSEHRGGLGVRGWGGGGGRETRGAGSEGSPGSEHGKGRAAAGSSLAFRCSSPDPPRTAHPGSDMQVCEAKCLRGAPRGENPEEKETARIGPGKRRDGAAYAEWRGRPPFGRR

SEQ ID NO: 1024671 - protein, 50 aa, Homo sapiens
MEQPMQNGEEDRPLGGGEGTSLQEIDGGTGYADLTPNFPMAHNPIRAESN

SEQ ID NO: 1024672 - protein, 160 aa, Homo sapiens
MAKKYFTSDKTNEDWDAGPFMLHDKWDGRSKRNPGPPCVEAGNGGNAALEQRRAANPQRSSFGNAGTQSPEPGGGGNPRASSWPRKHFLAAPPFKIVFVRNVGWGPNFICRKKYNGGRPGNPTCLEPLGAEHWRSHWWHTQIWGHANFDTLSLGEQPTVL

SEQ ID NO: 1024673 - protein, 66 aa, Homo sapiens
PSCMDATVPWWKKAAVPAGPLCLACPGLLHAGHLPEHAGLLTVPPEQGKEGPTSPTHMSDPSQLEA

SEQ ID NO: 1024674 - protein, 277 aa, Homo sapiens
RALPVRVVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 1024675 - protein, 202 aa, Homo sapiens
RALPVRVVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTNLPPRAALRPRHLLLGRGHEDLALSFLSLNLPDASWALGLPSSSRVDERNEHRGWLWVLGTTF

SEQ ID NO: 1024676 - protein, 271 aa, Homo sapiens
SPRPRRLLDSRWQSGVGFWTDGTDACYRRSLGELVSLLLLPRLIPMYVSAFLVLSHSPLYGHTAVVYPVTCGWTFELSPVLAVMSKAAENVHEQVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 1024677 - protein, 230 aa, Homo sapiens
RALPVRVVWNAVDSGHCLQTYSLHTEAVRAARWAPCGRRILSGGFDFALHLTDLETGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHVEGYSVGCECSPGGDLLVTGSADGRVLMYSFRTASRACTLQGHTQACVGTTYHPVLPSVLATCSWGGDMKIWH

SEQ ID NO: 1024678 - protein, 223 aa, Homo sapiens
MQGTQLFSGRSDFRITTLKFHPKDHNIFLCGGFSSEMKAWDIRTGKVMRSYKATIQQTLDILFLREGSEFLSSTDASTRDSADRTIIAWDFRTSAKISNQIFHERFTCPSLALHPREPVFLAQTNGNYLALFSTVWPYRMSRRRRYEGHKVEGYSVGCECSPGGDLLVTGSADGRVLMYSFRTASRACTLQGHTQACVGTTYHPVLPSVLATCSWGGDMKIWH

SEQ ID NO: 1024679 - protein, 194 aa, Homo sapiens
MSDLSYYLGLIGGLYFLLLSDAAGLCRCTQDYWLGWNVIAGSPPSPQRSRVCLQVPHGALVAETGLAFHCMSCSLSSKLRSIAVYYDNPHMVPPDKCRCAVGSILSEGEESPSPELIDLYQKFGFKVFSFPAPSHVVTATFPYTTILSIWLATRRSILAWIAYIKERKAVCLYSAGDLTGRPDRFMVAPVARLG

SEQ ID NO: 1024680 - protein, 105 aa, Homo sapiens
MGLNRSSTARVWVDLCTSVTMETYVQGRGQTHTAWISAEIDTCRGISHINYSRLLNTERCPKCTNVFCRCLFTLNEVDVSIRYNVDIVCDLAAHTADSLVNEAFG

SEQ ID NO: 1024681 - protein, 1109 aa, Homo sapiens
MLFTWESIFLTVLGHSFFAEGFCLGLSGPYLDPEQSSSFRFEWLIKLAPNISGTVEGNRTLVPLTLVEYTLYFHNPELCREFSSSRVPLLLFKIGFETCHRKVALQKYTVQCKKMLSHWPTLLRIAKVPTSHMCLNLYKPVFPFKKTRHLYPLTLQATPLAPFRLTLLSPGLGHQPGTCDTSAALQDLHYMFQVGVRTRYVLTLMDMTKDDDSVNKALLTGLSACDGECNEEGWILTKDWLLLLFRLVSQPLQHKSKSPVEFSFMHVCGLSSGTVVYHIVKYHTAKKITPRKALSHIPILLSYMFSKHSSTSLTFLLYVDSQIILWGWDEFKSYTKISVKSLKVYGVGGHLVHFSKASTRKPHRTVLVVHVLVFFLKCAIYCIVLPHNCTEMYSEFVEFLAEILLCLFHMNIFVILKEILFKFPFEKPHGSVIHVTDTFGFQCCLETVAKAGWCCLQAAAYGRQSHSNEIAPLNCAVSIPWVMAQGRTTYFVTRADSGFLDPQPQIIPGSIAFFTVLSEFPELKSAIAVDKTAIPTSDEIVPLLSSNGLGLRDVVKHFGGFKIFVRSPHFSIHPHWLPCTHLTVASQKSWLSLRWGAHGAAGDFLEKCKENSYSVSTSRATCVNLTKFTNNPPFFNICYCKHEYLNTDKKNTHTNRPTALEATELAQNYQRTLTGRSGFSRNIAYKCISVYLESILTAFQLIFEVISVKTGKQLRCSNFFFLVQTFNNLLIQQSLLSYIFICKVTLSAWQGAGACFFHIRPFLQYPGKHIITKGFYLKSFMEGLQFEKLHMFTEELLPSMQTLCSVVSQLCDNKMAISDLQGAVGNQIKYVIRDIITSIVFNRALCQLLRQSFNKVYRILKLVTITSLRDAVRNLANLEEEEAFRKGFSIYQKYLTSSNQYVMQTCFKGTKGIAKYLPKGGTFYLKFETNEISKISPKKDYPFKVIIFTKMKIFLLLFSCKIVESCFVGLRVTFSSNTKFFFYVEISFLFLLAIEMQCDEVFLFLFSLSHYVLASHFMKKRRKIPIYRALLVEALFNQQKIMAIGGPFIYCLYVVFEKKNHDAFVFAVCTPEINSISCLNAIHFAHVLYISNAYCIFICVHIYHQIFCT

SEQ ID NO: 1024682 - protein, 95 aa, Homo sapiens
MSFIFDWIYSGFSSVLQFLGLYKKTGKLVFLGLDNAGKTTLLHMLKDDRLGQHVPTLHPTSEELTIAGMTFTTFDLGWTCFKLEDGGKNYLPAIH

SEQ ID NO: 1024683 - protein, 95 aa, Homo sapiens; identical to SEQ ID NO: 1024682

SEQ ID NO: 1024684 - protein, 214 aa, Homo sapiens
MSDEGSRGAAACALCRCPRASQWLLFSGAGCAGWLLWLGGSVQFPGPHATSNGLAADGHHLLVALKSQTLLQNLMSEDDVRQCAARMASVEHAIPEAQREEVDADEDAASECCSQATCRSHLAGGGLSQARRTMLRSDEGAHVMLLSAKLCEKHGTNARRLLPAVWHAPAGGPVPGGGGLRDCGWLGGQPHRHVQSERAAIQEQVLGLGACVTC

SEQ ID NO: 1024685 - protein, 141 aa, Homo sapiens
MSCRSRRSRWACKEASVEHAIPEAQREEVDADEDAASECCSQATCRSHLAGGGLIQAWRSMLRSDEGAHVMLLSAKLCEKHGQMPADFCQLSGMHLLVGRYLAAGGCGTAGGWAASLIGTCSQNVQAIQEQVLGLGACVTC

SEQ ID NO: 1024686 - protein, 151 aa, Homo sapiens
SPFFPAGVLPKSIGTVKKTLEIVNLGAGTGEGWGATQWTPLNSLEHQDAPMAKVLSSMFFVFSSSLGSLALTGFQLALQLPGLSLHGTLALGLWLQLRSCSAGAAFGISGCGSGCDPEQDCVVAAVVVGPESALRGLIAHHEVRRRPIARA

SEQ ID NO: 1024687 - protein, 156 aa, Homo sapiens
MASALEQFVNSVRQLSAQGQMTQLCELINKSGELLAKNLSHLDTVLGALDVQEHSLGRFLGGLVGRVFLQCPSAPEIAKRYSQRLACSSSGSCDGEHIRVCKQTLLLGFAIQLTNALVERKQPLRGIGILKQAIDKMQMNTNQLTSIHADLCQLCR

SEQ ID NO: 1024688 - protein, 127 aa, Homo sapiens
MCDRKAVIKNADMSEEMQQDSVECATQALEKYNIEKDISSHIKKEFDKKVQFPPGIASVRRNFGSYVTHETKTLHRTSTVGQVAYFFMCNIWLIEAMDCAIHPVIQSKNKDCSLDSIIPETEIVMPC

SEQ ID NO: 1024689 - protein, 70 aa, Homo sapiens
IAPPVPPITAPLIAPSRPLRQNASSSTNGSSTHFCTFGLEHFLHRLDLEPFSVTAPTPADQQLLPFQSLI

SEQ ID NO: 1024690 - protein, 263 aa, Homo sapiens
QETLSCSYLGVPSDADSPAASNKISGASNSKPNRPSLAKIFSVIGWKSGQQQGLIAYSTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGR

SEQ ID NO: 1024691 - protein, 199 aa, Homo sapiens
QETLSCSYLGVPSDADSPAASNKISGASNSKPNRPSLAKIFSVIGWKSGQQQGLIAYSTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEVADMLLELCVTELEDVATDSQSGR

SEQ ID NO: 1024692 - protein, 148 aa, Homo sapiens
MTKILTDGLKKIQIFIIMSTDTWDPVCKCQKRVCICCPERLHTSDKPLPEVCFLSVRKHTLTGFNHGPLLSGNALSSHTEPGCHPYKLKQAQIREINKIPHPRIKKNQGINGLMDFPWRRKCGTIGISHRDEIPYHSRVWRLIINLLI

SEQ ID NO: 1024693 - protein, 83 aa, Homo sapiens
MIQSIWLDSQLFQLLSLPARCISDGTHQTLNSFPELESATEVFRASSVAALMETKKSLRAGNLHHDQPITQEHSQLLLQGCTC

SEQ ID NO: 1024694 - protein, 153 aa, Homo sapiens
PTRFFREQCGQGVTGSGARPGRYLLPIFLCRRNWMLLRCRPARGTAPPRVRSTRRSPAPCRRSALPLLALRPEARALLASSATLLLARPGPERALSRLLQDARLLLVQGHAVAHVHASAPNCISTSANLRVLPFTTVVDCDTVTLMPFSSVAA

SEQ ID NO: 1024695 - protein, 239 aa, Homo sapiens
MEREYMFCDITETVSILRYIFTCRIKPFLVSTAASSIFILQISVQAAQPGQGLRQRAFLTPRGELPDQRLKGLRRHKNPQPSIPKKPSGVTFPGGENITRSSLVTVRQGFRMPGIQRDTGPAVRITLPTVRHHEVLAGDQQVQTGCGVPGPRAFSGVLAVNADLQAQRAGLNGFRDGRNNRAQLLCQRSCLFCVPVQAAQHQRENSFQPRQGEDFCQHRVRHLLQANTVALEIIVGRKV

SEQ ID NO: 1024696 - protein, 133 aa, Homo sapiens
FVSSWEYKDIFFPISDTGTRHLQYNSPTHQGLEVYIGKAQASLCFQSQTKPMTSSRDKMYFQPTRCRWGDPPGAESQGYRAKPQGCAARPELPRGRTFEEEDLAAASGRPPPPGPGCLFAVQGCARPANYTAW

SEQ ID NO: 1024697 - protein, 72 aa, Homo sapiens
HIQRAFMIIIIGSVTGDLFNVFRSIAHRKGITRHFQHLRIVTRCRQSLPHFAVTDPSVSVTAKYRLLYVDRE

SEQ ID NO: 1024698 - protein, 124 aa, Homo sapiens
LTRRCTCQLFAQAGYVGFGSHHRHMLALLRHANLLNALRQVIHQNPVGTIDRFTRVTVFVLLTRHIQCLIAYVDFWRVKARRIFQGGKLVCYRGVLQSFRFRRRLICRFWRIAQGRAQIVEIGP

SEQ ID NO: 1024699 - protein, 40 aa, Homo sapiens
IETNRLQEALNLFKSIWNNRWLRTISVILVSFNKARFLLR

SEQ ID NO: 1024700 - protein, 39 aa, Homo sapiens
IETNRLQEALNLFKSIWNNRGWVWLSSRMTMLELLLATT

SEQ ID NO: 1024701 - protein, 114 aa, Homo sapiens
LRKPPIMAEGKGGVSCLTWPEQEVERGRCHTLTNNQISGQLTQYQENSTTKLWLIIHEKPPTTQSPPTRPYLQHLGLQFNMRFGGNTDPNHITHKLQLLHTHDNPLICEGLICS

SEQ ID NO: 1024702 - protein, 174 aa, Homo sapiens
MGEDLQWPLLLSLPNLHPCCTCNGSILHCQGGRLRVRLPARHEVIHGPIHSMVMKSRPFPVFSCATPAWEKVPKTISSKLPCTVDPMDTNYCFSSTEKNCCVRNGTLTSARPRLEVDPRAQGYHANFCLGPCPYIWSLDTQYSKVLALYNQHNPGASAAPCCVTQRWSRGHRVL

SEQ ID NO: 1024703 - protein, 99 aa, Homo sapiens
MDHHILQKAQCFQGNLGRIAKSVSLVRMGPCLPGQWRKVNIISVTNKGLLHSFDLLKAVCLEFSPKNTVLATWQPYTTSKDGTPGIPNLHLYDVKLGTC

SEQ ID NO: 1024704 - protein, 259 aa, Homo sapiens
MVEDTGKKRRKKREGERTARNRNEKRGRQANSKETSSKKERTSGSDREQRRKKQEEGRTKKEKRERKEEQQKKEEKQEKDGREGKEQGRKREKRERAKKKRKQERKREEATRRREDRDEEERERKEKKSRGQRDKKEEKRKKQRRKKEGSEERKKKQKSNDNKEKRTERQKKEKEEKKERQKTDTERERRRKKKENEQHRQNRKENADKQSRDTKRSIGKREESRTEATAEERITRRGERDTEEEGATSRRHEGLTTDT

SEQ ID NO: 1024705 - protein, 115 aa, Homo sapiens
MARNAEKAMTALARFRQAQLEEGKVKERRPFLASECTELPKAEKWRRQIIGEISKKVAQIQNAGLGEFRIRDLNDEITSFLREKGHWEARIKELGGPHYGLPYMLDHEGKSSTTP

SEQ ID NO: 1024706 - protein, 180 aa, Homo sapiens
AVLILAVCSLSYPSVPSSVFPRAGCIRTGFVPQLGAIGPVSPLLAGHSCGEVGQLNSVGFHEEAESRGWPQTHTEGGGWLGTRDVEHKSLSSPINQAPSPQVSPAHWIRKSSVRPEAPGTGFSQFSREGHLQVTETSSTREDLTFESLPGHQRPSQPHGKLPRPDSGIIPPWLRHQPGKT

SEQ ID NO: 1024707 - protein, 118 aa, Homo sapiens
MIITNYNPSLYTVPINRLTTQQFQAIPYLSFSYPSPESSCLWGLEMSPPRPSLPSHSWVSSGLREPHIHLHLDTCSRMARPLPPDAVVRVICQKKAFWMLLRCTLLGEPGIRPTVLAV

SEQ ID NO: 1024708 - protein, 200 aa, Homo sapiens
AERRHLVGAKPTPGSEQQPLRCPWPVSFHLSTSMGNIFANLFKGLFGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRQQELVHSGHLRHQRRRAL

SEQ ID NO: 1024709 - protein, 200 aa, Homo sapiens; identical to SEQ ID NO: 1024708

SEQ ID NO: 1024710 - protein, 127 aa, Homo sapiens
AERRHLVGAKPTPGSEQQPLRCPWPVSFHLSTSMGNIFANLFKGLFGGEGAGGGGGGGMWGRGGGGGTIRSGVRGGTGGCKSGGGGGGGRGRVGGGQWLGGEGLVGGGGGGGGGGRGGGVRAGGGLA

SEQ ID NO: 1024711 - protein, 262 aa, Homo sapiens
MACYSRTPDLGDPPTSASKSAGITGMSHCAQLKADIFKRLHTVRLHTSMKQRVVLWLCSPLVCNPEIRQKSPKPSFRYAHHYIANAHHSTEQHLHLQSKKYKAESLCSGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRQQELVHSGHLRHQRRRAL

SEQ ID NO: 1024712 - protein, 171 aa, Homo sapiens
MHTSMGNIFANLFKGLFGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRQQELVHSGHLRHQRRRAL

SEQ ID NO: 1024713 - protein, 127 aa, Homo sapiens
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMACQTGTFAREG

SEQ ID NO: 1024714 - protein, 131 aa, Homo sapiens
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHRLREKDKHIEEVRKNKESKDPADETEAD

SEQ ID NO: 1024715 - protein, 129 aa, Homo sapiens
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMACQTGTLRERVST

SEQ ID NO: 1024716 - protein, 65 aa, Homo sapiens
NGKQFPQRGKTAYEHELPFKYGPHLIGEIWALEAPRNSGTKLPHCNPQPSLSSLGLPGVCPPSLA

SEQ ID NO: 1024717 - protein, 87 aa, Homo sapiens
NSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 1024718 - protein, 87 aa, Homo sapiens; identical to SEQ ID NO: 1024717

SEQ ID NO: 1024719 - protein, 96 aa, Homo sapiens
VADPFCLRVGWCSICLGAGIFVDRTRRSLYWEIMGTAPKLKEGMKPAGSVNDMALDAFDLDRMKQEILEEVVRELHKVKEEIIDAIRQELSGISTT

SEQ ID NO: 1024720 - protein, 116 aa, Homo sapiens
MCDQTKHSKCCPAKGNQCCPPQQNQCCQSKGNQCCPPKQNQCCQPKGSQCCPPKHNHCCQPKAPCCIQARCCGLETKPEVSPLNMESEPNSPQTQDKGCQTQQQPHSPQNESRPSK

SEQ ID NO: 1024721 - protein, 255 aa, Homo sapiens
MRPEDRMFHIRAVILRALSLAFLLSLRGAGAIKADHVSHLCQRLYMTHRPTGEFMFEFDEDEQVLCGSGQEGDRLASGGVGRAFSFEAQGGLANIAILNNNLNTLIQGVPTTLRPPMIPPEVTAVFPKEPVELGQPNTLICHIDRFFPPVLNVTWLCNGEPVTEGVAESLFLPRTDYSFHKFHYLTFVPSAEDVYDCRVEHWGLDQPLLKHWEAQEPIQMPETTETVLCALGLVLGLVGIIVGTVLIHKVSAFWP

SEQ ID NO: 1024722 - protein, 183 aa, Homo sapiens
MPDVGTLQRLPKVIGYPEPRQRSLAFTARQDRWLTRPWADGLVSLGVPRQRGQCWDAALALAGQRFPARAHVAVQSTQGQHVLYSRDHSVAESLNYVASWNMSMLQTQDLVKSVQATTEKQGTEKPFTFSIALRALRVPGHQQGARPCPALIHQKGRMGDDSCVLMPSDPVSQFIKLTEDEFL

SEQ ID NO: 1024723 - protein, 144 aa, Homo sapiens
MPDVGTLQRLPKVIGYPEPRQRSLAFTARQDRWLTRPWADGLVSLGVPRQRGQCWDAALALAGQRFPARAHVAVQSTQGQHVLYSRDHSVAESLNYVASWNMSMLQTQDLVKSVQATTEKQGTWDRHRSSQHILSPGGRRRVRK

SEQ ID NO: 1024724 - protein, 122 aa, Homo sapiens
METLTSQCILLPTHTHTHLSHMHAYTHTHTHTHTHTYTHTHTRSLSLSLSLSVSVLSVWSGGRGASVLQHPSARRHPRPSPPESRTLPRTPGSLPSAGDFCFVVSEGTSNVGPVVGGWKSGE

SEQ ID NO: 1024725 - protein, 99 aa, Homo sapiens
STDTRRPPRLKMPSQGEPNKPMSCSFGVFPNPLGALLLLATTPAAEDAAAKATAQPPTETGESSQAEENIEAVDETKPKESARQDEGKEEEPEADQEHA

SEQ ID NO: 1024726 - protein, 151 aa, Homo sapiens
MLSILKPRRSQEWRTALRRYCCPTDLQAPRSPVPPIRKVGISDVIVHANLATSLKKNTCNCQADLLSWRSWVNGISCHCPNLRPLSKSIFRDSTSLCSLSQQRLCPLHSKPEACWGLFVSVHAHFRVQSGGRGIRMGKKSRVSRNDETLQE

SEQ ID NO: 1024727 - protein, 210 aa, Homo sapiens
FSTVPTAITPPGGCTRVRGSSGVRLTAGRDLSRNLSPLTEPSLRSVHGLLLDTARIQKSMLSILKPRRSQEWRTALRRYCCPTDLQAPRSPVPPIRKVGISDVIVHANLATSLKKNTCNCQADLLSWRSWVNGISCHCPNLRPLSKSIFRDSTSLCSLSQQRLCPLHSKPEACWGLFVSVHAHFRVQSGGRGIRMGKKSRVSRNDETLQE

SEQ ID NO: 1024728 - protein, 143 aa, Homo sapiens
MLSILKPRRSQEWRTALRRYCCPTDLQAPRSPVPPIRKVGISDVIVHANLATSLKKNTCNCQADLLSWRSWVNGISCHCPNLRPLSKSIFRDSTSLCSLSQQRLCPLHSKPEACWGLFVSVHAHFRVQSALSPALHKVVAQIW

SEQ ID NO: 1024729 - protein, 164 aa, Homo sapiens
EFGQRSLREEAFPFLGLTKRKRKLASDYGGGCDQFRRKTQEISRPKFAILKVRGESSDSRSVKDEGSSDPKDIDQDNRSTSPSIPSPQDNESDSDSSAQMLQPSPLQAPNWAPQLPPQLLQGPLSCPRQAHALCHCSSPQGSPNSQAPNAQAPTAPVPHTHIQQ

SEQ ID NO: 1024730 - protein, 108 aa, Homo sapiens
MGPRHFWSPGRQELRAPQSFWFPFLLAGLLPAAGPRSRPGRGGLSSFGASPPAAGRGPPAPARALRGLSLGLCRALRLLGPLRGLLLAAAASFSPSFSSAFPRRPGRA

SEQ ID NO: 1024731 - protein, 70 aa, Homo sapiens
MGGSSCRCEMEGSARRGMSSLIRHRHALAQSRMPRAWPPPMGLPPLRQRTLKRSHPRGLLLTLPERQQMW

SEQ ID NO: 1024732 - protein, 135 aa, Homo sapiens
MPHPLSRTTKRGLECPNEIQPPLPDPILFLFERFFVHFKFKGRVWTKGRLFHPESAYLSEQAVCQGVWQGRAGGHGLTYLKSSGSGRGPEHLPTVNQKEGIPPLLPASPSPPKQAKPFPFPRSWVEKQVWSFAAS

SEQ ID NO: 1024733 - protein, 633 aa, Homo sapiens
MLNAAADRVKWTRSSAAKRAACLVAAAYALKTLYPIIGKRLKQSGHGKKKAAAYPAAENTEILHCTETICEKPSPGVNADFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFTNQTYYKVINMDGRLANPDQSLTEDIMMFSQSVAHLYSNLTKPILDVMLTSYTLIQTATSRGASPIGPTLLAGLVVYATAKVLKACSPKFGKLVAEEAHRKGYLRYVHSRIIANVEEIAFYRGHKVEMKQLQKSYKALADQMNLILSKRLWYIMIEQFLMKYVWSSSGLIMVAIPIITATGFADGEDGQKQVMVSERTEAFTTARNLLASGADAIERIMSSYKEVTELAGYTARVYNMFWVFDEVKRGIYKRTAVIQESESHSKNGAKVELPLSDTLAIKGKVIDVDHGIICENVPIITPAGEVVASRLNFKVEEGMHLLITGPNGCGKSSLFRILSGLWPVYEGVLYKPPPQHMFYIPQRPYMSLGSLRDQVIYPDSVDDMHDKGYTDQDLERILHNVHLYHIVQREGGWDAVMDWKDVLSGGEKQRMGMARMFYHKPHLPFIPLTC

SEQ ID NO: 1024734 - protein, 633 aa, Homo sapiens; identical to SEQ ID NO: 1024733

SEQ ID NO: 1024735 - protein, 740 aa, Homo sapiens
MTHMLNAAADRVKWTRSSAAKRAACLVAAAYALKTLYPIIGKRLKQSGHGKKKAAAYPAAENTEILHCTETICEKPSPGVNADFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFTNQTYYKVINMDGRLANPDQSLTEDIMMFSQSVAHLYSNLTKPILDVMLTSYTLIQTATSRGASPIGPTLLAGLVVYATAKVLKACSPKFGKLVAEEAHRKGYLRYVHSRIIANVEEIAFYRGHKVEMKQLQKSYKALADQMNLILSKRLWYIMIEQFLMKYVWSSSGLIMVAIPIITATGFADGEDGQKQVMVSERTEAFTTARNLLASGADAIERIMSSYKEVTELAGYTARVYNMFWVFDEVKRGIYKRTAVIQESESHSKNGAKVELPLSDTLAIKGKVIDVDHGIICENVPIITPAGEVVASRLNFKVEEGMHLLITGPNGCGKSSLFRILSGLWPVYEGVLYKPPPQHMFYIPQRPYMSLGSLRDQVIYPDSVDDMHDKGYTDQDLERILHNVHLYHIVQREGGWDAVMDWKDVLSGGEKQRMGMARMFYHKPKYALLDECTSAVSIDVEGKIFQAAKGAGISLLSITHRPSLWKYHTHLLQFDGEGGWRFEQLDTAIRLTLSEEKQKLESQLAGIPKMQQRLNELCKILGEDSVLKTIKNEDETS

SEQ ID NO: 1024736 - protein, 152 aa, Homo sapiens
VDRGGGLHIPVVALRFLPLSLRAHGGGQSGGDGGAKNDPAASSLPPAHLPCSVSQSAAGARFVLRPRACGAQAQRLQSEAGELSESEGCAGGQRESTARNITQRGNVAKDLEKMPPKKKASVGPLVIWLSSFWWSCGSAIFPDYSKYQDGAL

SEQ ID NO: 1024737 - protein, 252 aa, Homo sapiens
YHEEELRQLLPHDTRAGWWKSGDQKENLLKRRRQQKKHRKKNNIKKNPPPHNKNLRVEGWEGTKQGPFTKEGNHEAHFRLPGMPFAWGCRRISSGPSLAWHSSVEEVSPNPKESRRGAKRGAPNGPLRVRWPPSQRIVPNSQPEMVEAVKKHIFKPLLPLNEETRLSPSRYPRTALLNAIRKLPVGQSSGTHRAPAGAQQAALARRARLLPCPPAAPLGHSSRRRLVPPDDPASQIPGSRARPPPVQLPPKP

SEQ ID NO: 1024738 - protein, 112 aa, Homo sapiens
GSYVVEPGPWRAASGGSSRGSVNVAEDRSTRARRCVALSSWGRDSCGCTGCPRPPACVFSALLVPGQDPGHLQGLSFALAMSDGPGRFLGHRPWEASPVWGPRAAWGGVFIW

SEQ ID NO: 1024739 - protein, 39 aa, Homo sapiens
MPSDEITIETPAALVCQSVSSEAIFRLIKGRHTMHQTWR

SEQ ID NO: 1024740 - protein, 125 aa, Homo sapiens
MYVKLVEALCAEHQINLIKVDDNKKLGEWVGLCKIDREGKPRKVVGCSCVVVKDYGRSLRPGMSLKSISNARNEEINPWLASTSTHNHHTITSTTPNNTTTTHTERQYTNNSNTQTNVAPRPKEA

SEQ ID NO: 1024741 - protein, 125 aa, Homo sapiens; identical to SEQ ID NO: 1024740

SEQ ID NO: 1024742 - protein, 113 aa, Homo sapiens
MYVKLVEALCAEHQINLIKVDDNKKLGEWVGLCKIDREGKPRKVVGCSCVVVKDYGKESQARDVHGRVFQMQEMKKSNIVWFTMWTSVEWCECGEGLNSGGGRNAGKLRGGWC

SEQ ID NO: 1024743 - protein, 106 aa, Homo sapiens
MAEEGSEDCPHPRWPSTWNSRAAKALDKYVYQSQYCGFLQPGTKCATQGTEGMGVHGCKRKILNGHPSYRKPRNGRKPIFVCLHPTVMSLCMSSWWRPFVLNTKST

SEQ ID NO: 1024744 - protein, 81 aa, Homo sapiens
LLQRLAEQSQRLADGVEALNRTLERLVKARPTREASPSLQDGGPASGVAQGPAGGSQDSPKGTHSGLEVFSGMILKVEEEI

SEQ ID NO: 1024745 - protein, 81 aa, Homo sapiens; identical to SEQ ID NO: 1024744

SEQ ID NO: 1024746 - protein, 81 aa, Homo sapiens; identical to SEQ ID NO: 1024744

SEQ ID NO: 1024747 - protein, 77 aa, Homo sapiens
EGHFATITLTFIDKNGETELCMEGRGIPAPEEERTRQAWQRYYFEGIKQTFGYGARLYKGQRQVDSILLATSVQLFS

SEQ ID NO: 1024748 - protein, 163 aa, Homo sapiens
WRGASLRALCLFECSCVLWAEGACCDARVALRCAQGRLGALNLHGEGCLHGALLMGAVRLPVEGRAHSSGAVSETWDRALPLGGPWMRVPVAVRVLLVPGARRGPVSVAAHGTWASGCSADSWSLLRWSPVPQPRLGPSSPRSRDPGPLCSPWAPVGFEALGL

SEQ ID NO: 1024749 - protein, 150 aa, Homo sapiens
AYRLTLTQIALRELNESDEGKPASPLLVNAVPQGWLLPLHLPPGIRTHAPAHHLAPATPRPEPWNPWPPTRARHSGPLPAHPAARLCVCARAARLDLEKGLRTPGSCDALHLSRLHQRLPLMSWSRALQGPLYMPSPFYKIFPLKTTYFL

SEQ ID NO: 1024750 - protein, 129 aa, Homo sapiens
MFLSFPTTKTYFPHFDLSHGSARLRARKKVADALTNAVATVDDMPKALSALSEILKGNKLRVDPVNFKLLSHCLLVTLAAHLPAEFNPAVHASLDKFLASVSTVADLQITVKLEASVGNAFFALGVPQP

SEQ ID NO: 1024751 - protein, 621 aa, Homo sapiens
ETEQGEQQRQLLEEELARLQREAAAARKKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKANVEEARRLRERAEQESARQLQLAQEAAQKRLQAEEKAHAFAVQQKEQELQQTLQQEQSVLDQLRGEAEAARRAAEEAEEARVQAEREAAQARRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAEELLEPRRRSLQ

SEQ ID NO: 1024752 - protein, 444 aa, Homo sapiens
ETEQGEQQRQLLEEELARLQREAAAARKKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKANVEEARRLRERAEQESARQLQLAQEAAQKRLQAEEKAHAFAVQQKEQELQQTLQQEQSVLDQLRGEAEAARRAAEEAEEARVQAEREAAQARRQVEEAERLKQSAEEQAQARAQAQAAAEKLRKEAEQEHPRGMRHPRGIAPQDKHPR

SEQ ID NO: 1024753 - protein, 579 aa, Homo sapiens [sequence omitted]

SEQ ID NO: 1024754 - protein, 561 aa, Homo sapiens
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNTLSKFPITTLCCVPTIFRLLVQEDLTRYQFQSLRHCLTGGEALNRDVREKWKHQTGVELYEGYGQSETVVICANPKGMVDDEGNVLPPGEEGNVAVRIRPTRPFCFFNCYLDNPEKTAASEQGDFYITGDRARMDKDGYFWFMGRNDDVINSSSYRIGPVEVESALAEHPAVLESAVVSSPDPIRGEVVKAFIVLTPAYSSHDPEALTRELQEHVKRVTAPYKYPRKVAFVSELPKTVSGKIQRSKLRSQEWGK

SEQ ID NO: 1024755 - protein, 581 aa, Homo sapiens
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNVPVSEPEALSDRRRGPQPDVREKWKHQTGVELYEGYGQSETVVICANPKGMKIKSGSMGKASPPYDVQIVDDEGNVLPPGEEGNVAVRIRPTRPFCFFNCYLDNPEKTAASEQGDFYITGDRARMDKDGYFWFMGRNDDVINSSRSSCLHFPPPFEDFMGVEGSPLEELFFPSSYRIGPVEVESALAEHPAVLESAVVSSPDPIRGEVVKAFIVLTPAYSSHDPEALTRELQEHVKRVTAPYKYPRKVAFVSELPKTVSGKIQRSKLRSQEWGK

SEQ ID NO: 1024756 - protein, 543 aa, Homo sapiens
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNTLSKFPITTLCCVPTIFRLLVQEDLTRYQFQSLRHCLTGGEALNRDVREKWKHQTGVELYEGYGQSETVVICANPKGMVDDEGNVLPPGEEGNVAVRIRPTRPFCFFNCYLDNPEKTAASEQGDFYITGDRARMDKDGYFWFMGRNDDVINSSSYRIGPVEVESALAEHPAVLESAVVSSPDPIRGEVVKAFIVLTPAYSSHDPEALTRELQEHVLPKTVSGKIQRSKLRSQEWGK

SEQ ID NO: 1024757 - protein, 561 aa, Homo sapiens; identical to SEQ ID NO: 1024754

SEQ ID NO: 1024758 - protein, 561 aa, Homo sapiens; identical to SEQ ID NO: 1024754

SEQ ID NO: 1024759 - protein, 130 aa, Homo sapiens [sequence omitted]

SEQ ID NO: 1024760 - protein, 298 aa, Homo sapiens
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGGPQDGRALPEQLRTGFCGQRKVPEQLVSEDPRTESGEWSGGGGVRGKVSGTEVREPTELLRSQ

SEQ ID NO: 1024761 - protein, 579 aa, Homo sapiens [sequence omitted]

SEQ ID NO: 1024762 - protein, 608 aa, Homo sapiens
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNTLSKFPITTLCCVPTIFRLLVQEDLTRYQFQSLRHCLTGGEALNRDVREKWKHQTGVELYEGYGQSETVVICANPKGMKIKSGSMGKASPPYDVQIVDDEGNVLPPGEEGNVAVRIRPTRPFCFFNCYLDNPEKTAASEQGDFYITGDRARMDKDGYFWFMGRNDDVINSSRSSCLHFPPPFEDFMGVEGSPLEELFFPSSYRIGPVEVESALAEHPAVLESAVVSSPDPIRGEVVKAFIVLTPAYSSHDPEALTRELQEHVKRVTAPYKYPRKVAFVSELPKTVSGKIQRSKLRSQEWGK

SEQ ID NO: 1024763 - protein, 444 aa, Homo sapiens
MMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNTLSKFPITTLCCVPTIFRLLVQEDLTRYQFQSLRHCLTGGEALNRDVREKWKHQTGVELYEGYGQSETVVICANPKGMVDDEGNVLPPGEEGNVAVRIRPTRPFCFFNCYLDNPEKTAASEQGDFYITGDRARMDKDGYFWFMGRNDDVINSSSYRIGPVEVESALAEHPAVLESAVVSSPDPIRGEVVKAFIVLTPAYSSHDPEALTRELQEHVKRVTAPYKYPRKVAFVSELPKTVSGKIQRSKLRSQEWGK

SEQ ID NO: 1024764 - protein, 543 aa, Homo sapiens; identical to SEQ ID NO: 1024756

SEQ ID NO: 1024765 - protein, 130 aa, Homo sapiens [sequence omitted]

SEQ ID NO: 1024766 - protein, 208 aa, Homo sapiens
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLR

SEQ ID NO: 1024767 - protein, 927 aa, Homo sapiens
ARGRRRREPVAPVAPGRGRGRKMPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACICSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSRCSPSPEHLRCIWPLAELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 1024768 - protein, 994 aa, Homo sapiens
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSGSPHELGPQFPSKGYSLLGPGSQNSMGAGPCAPGHPDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 1024769 - protein, 502 aa, Homo sapiens
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGCE

SEQ ID NO: 1024770 - protein, 201 aa, Homo sapiens
WSSRACEAQASPAPRGLNKVLSHCHHAGSREKTQDHCLPQTLAEEPDAGQGQGMLGAGARGARGLRRCATCAERIPNAADPWPVPSSDLEWKLVALGQLGIAKGLEALRLGLDEQADYPEPLDSGHKNWPHILNNPGEQIYTGHLDKACTGWNATLRMWDSFKEDHGPLDASDAPVIIGPERPNATVETPCMETTNSHNSD

SEQ ID NO: 1024771 - protein, 31 aa, Homo sapiens
MARAWEVEVAVNHDSATALRPGQQSETLSPK

SEQ ID NO: 1024772 - protein, 107 aa, Homo sapiens
MMQGGYGSGGERYDSYESCDSRAVLSRDLYRSGYDYSELDPEMEMAYEGQYDARSPMASGYGRMWEDPMGPGASACLGVSAALPLLPEHHPPSLRGGARVAEAGNQT

SEQ ID NO: 1024773 - protein, 148 aa, Homo sapiens
MRSQLLSLAATTPSLGGPELSFYFTSTGFPLHFSLGDRARLRFGKKKKKKKKKKNLKIKEVHPCHSTQAELIFPCRFQDTFWPSAHSASCSLEQTERDSLRHRTFFFFFETEPGVTARPRLQKKKRGKLGACWLPHGNSFCVISLGFL

SEQ ID NO: 1024774 - protein, 113 aa, Homo sapiens
RPPEQQTAAWRCISRTATSTLLSKFDVLGFGAGFRDSAVQIGFSDTLASQRMEPCSIRTSDTPKVRNRSRKAVTYARAICGARSPAPTMGLVTISINGTPARCSRSATSSLVN

SEQ ID NO: 1024775 - protein, 131 aa, Homo sapiens
MSDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENTEKEDEPDERLSQHDAFGG

SEQ ID NO: 1024776 - protein, 110 aa, Homo sapiens
MSDIEEVVEEYEEEEQEEAAVEEEEDLREDEDEQEEAAEEDAEAEAETEETRAEEDEEEEEAKEAEDGPMEESKPKPRSFMPNLVPPKIPDGERVDFDDIHRKRMEKDLN

SEQ ID NO: 1024777 - protein, 136 aa, Homo sapiens
APFSIFLAKQWRCFNQVSLTTAAIRNESHLASTCVASSCHTGLSWHSAHGTDICGSGQEPVDGALHRNAGLGMGDPACPTLLRAPPNSDNRLGSGLPEIRHPPAPLLRIPNGPDLAWKLSSTWLARKAANRDDDSE

SEQ ID NO: 1024778 - protein, 107 aa, Homo sapiens
VTRRVIVEEVGVSWRVVDSGDRFKVLAVVSWGSGVKWVAPPESSVLEDEMRRLLHRKGVEGYQWQPVQTTSPPRALRAVSILVPSSSDITSCCSAAKLWVSTVPSFV

SEQ ID NO: 1024779 - protein, 270 aa, Homo sapiens
MALRGPGLERPPLTCPELRQEQCCGGCQVGGAGPERRGGLGASTLSPGPDPLQPCVAQQPFPSLPSPLPLQGTLHSSPPGATGRPPLCLSEPSSVSPRPRCFLLPWGSPRPCPRQSQTGGSRGSPAPRPAESGSSSRTTEGGASCPPHPCHCPPAPSPTQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 1024780 - protein, 410 aa, Homo sapiens
GSPSTNPHLSPLCPPCWEIFQALAKASAAPGSRAAGWVRTMASHKLLVTPPKALLKPLSIPNQLLLGPGPSNLPPRIMAAGGLQMIGSMSKDMYQIMDEIKEGIQYVFQTRNPLTLVISGSGHCALEAALVNVLEPGDSFLVGANGIWGQRAVDIGERIGARVHPMTKDPGGHYTLQEVEEGLAQHKPVLLFLTHGESSTGVLQPLDGFGELCHRYKCLLLVDSVASLGGTPLYMDRQGIDILYSGSQKALNAPPGTSLISFSDKANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 1024781 - protein, 273 aa, Homo sapiens
GDAPASSSHAHHQGGVEAGPALLPGAVPPMGVVGVSGPCPLNSTTASLLPQGLAQHKPVLLFLTHGESSTGVLQPLDGFGELCHRYKCLLLVDSVASLGGTPLYMDRQKKMYSRKTKPFSFYLDIKWLANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 1024782 - protein, 392 aa, Homo sapiens
MASHKLLVTPPKALLKPLSIPNQLLLGPGPSNLPPRIMAAGGLQMIGSMSKDMYQIMDEIKEGIQYVFQTRNPLTLVISGSGHCALEAALVNVLEPGDSFLVGANGIWGQRAVDIGERIGARVHPMTKDPGGHYTLQEVEEGLAQHKPVLLFLTHGESSTGVLQPLDGFGELCHRYKCLLLVDSVASLGGTPLYMDRQGIDILYSGSQKALNAPPGTSLISFSDKAKKKMYSRKTKPFSFYLDIKWLANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 1024783 - protein, 392 aa, Homo sapiens
MASHKLLVTPPKALLKPLSIPNQLLLGPGPSNLPPRIMAAGGLQMIGSMSKDMYQIMDEIKEGIQYVFQTRNPLTLVISGSGHCALEAALVNVLEPGDSFLVGANGIWGQRAVDIGERIGARVHPMTKDPGGHYTLQEVEEGLAQHKPVLLFLTHGESSTGVLQPLDGFGELCHRYKCLLLVDSVAFLGGTPLYMDRQGIDILYSGSQKALNAPPGTSLISFSDKAKKKMYSRKTKPFSFYLDIKWLANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 1024784 - protein, 134 aa, Homo sapiens [sequence omitted]

SEQ ID NO: 1024785 - protein, 186 aa, Homo sapiens
MSDNDDIEVESDEEQARFQSAADKRAHHNALERKRRDHIKDSFHSLRDSVPSLQGEKASRAQILDKATEYIQYMRRKNHTHQQDIDDLKRQNALLEQQVRALDEGEVNVPNLETKYHHPQTRASTPTPRAGTISAFDVGLGLQLGSPDPEDAPKQEEAPDWIARISHLGARASNNRLYCLTIVIII

SEQ ID NO: 1024786 - protein, 113 aa, Homo sapiens
MSDNDDIEVESDEEQARFQSAADKRAHHNALERKRRDHIKDSFHSLRDSVPSLQGEKLYFLFGKLCAPVLHRPKLMRDNATGMTFSSYPRCSKRREMLRFKDIAGSGPLTQMS

SEQ ID NO: 1024787 - protein, 113 aa, Homo sapiens
MRRKNHTHQQDIDDLKRQNALLEQQVRALDEGEVNVPNLETKYHHPQTRASTPTPRAGTISAFDVVARTPARKSDPEDAPKQGRSSGLDCQNKPPRGKGQQQQTVLSHIVIII

SEQ ID NO: 1024788 - protein, 75 aa, Homo sapiens
SHRHKGKKRNPENEKLPAKAVYDFKAQTSKELSFKKGDTVYILRKIDQNLVFEGEHRESGHLPDLIRRETHTSLR

SEQ ID NO: 1024789 - protein, 153 aa, Homo sapiens
MSSGAHGEEGSVRMWKTLTFFVALPGVAVSMLKCVPEVAPRRARETRVSSPSPNLRIRTKPFPWGDGNHTLFHNPHVNPTSKLATKMNKENLGTTYPGTRDHQTLVWTVTSAHGGRKSIWDLELTVSVDFVSRSDDVVYWSSRIPYAVWQEMA

SEQ ID NO: 1024790 - protein, 725 aa, Homo sapiens
MGLSLPKEKGLILCLWSKFCRWFQRRESWAQSRDEQNLLQQKRIWESPLLLAAKDNDVQALNKLLKYEDCKVHQRGAMGETALHIAALYDNLEAAMVLMEAAPELVFEPMTSELYEGQTALHIAVVNQNMNLVRALLARRASVSARATGTAFRRSPRNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYVTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELVLTIIDGPANYNVDLPFMYSITYAAFAIIATLLMLNLLIAMMGDTHWRVAHERDELWRAQIVATTVMLERKLPRCLWPRSGICGREYGLGDRWFLRVEDRQDLNRQRIQRYAQAFHTRGSEDLDKDSVEKLELGCPFSPHLSLPTPSVSRSTSRSSANWERLRQGTLRRDLRGIINRGLEDGESWEYQI

SEQ ID NO: 1024791 - protein, 106 aa, Homo sapiens
MYVENHCSRPALLLQLWGRGSPAQARGWQGVRNSPVACSSPFRQEHCMSEHFKNRPACLGARSPPQGHKWGESPSQGTQAGAGKCRACGKRVSEGDRNGSGGGKWG

SEQ ID NO: 1024792 - protein, 538 aa, Homo sapiens
MNLVRALLARRASVSARATGTAFRRSPCNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLRPAWALGLHPRVISGERALPRAPRQVQGSAELVESV

SEQ ID NO: 1024793 - protein, 260 aa, Homo sapiens
NSQPSPNWLGLLGDSQGTRQEGRRQETGPLQGDGGPALGGADVAPRLSPVRVWPRPQAPKEPALHPMGLSLPKEKGLILCLWSKFCRWFQRRESWAQSRDEQNLLQQKRIWESPLLLAAKDNDVQALNKLLKYEDCKVHQRGKKHKCSMISKVSPTHGASQEAQDLVLLASESIVSNPLSHRSHITHLSVKPGAMGETALHIAALYDNLEAAMVLMEAAPELVFEPMTSELYEGEGHGSGVKSRSDWLGISRQFSVMDII

SEQ ID NO: 1024794 - protein, 503 aa, Homo sapiens
MNLVRALLARRASVSARATGTAFRRSPCNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLR

SEQ ID NO: 1024795 - protein, 106 aa, Homo sapiens; identical to SEQ ID NO: 1024791

SEQ ID NO: 1024796 - protein, 106 aa, Homo sapiens; identical to SEQ ID NO: 1024791

SEQ ID NO: 1024797 - protein, 725 aa, Homo sapiens; identical to SEQ ID NO: 1024790

SEQ ID NO: 1024798 - protein, 195 aa, Homo sapiens
EVAVRGLLHSERSRGPDGSACPELSASPRPPAEAARAQSCGPSSSAESSPSSSAMAGWNAYIDNLMADGTCHGRGHRGLQGLALRLGPPSPGKRSSTSPPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 1024799 - protein, 130 aa, Homo sapiens
EVAVRGLLHSERSRGPDGSACPELSASPRPPAEAARAAGGAGGGAERREASKPLRLVGTPTVDNTSCADRRAVRDRGTIVGLQWKSPFRTMEPAGPACKNSPITQSTAQAWIDGDDPSDGAKDPESKYHT

SEQ ID NO: 1024800 - protein, 195 aa, Homo sapiens; identical to SEQ ID NO: 1024798

SEQ ID NO: 1024801 - protein, 195 aa, Homo sapiens; identical to SEQ ID NO: 1024798

SEQ ID NO: 1024802 - protein, 113 aa, Homo sapiens
MCYMRNGRSPTPLRALFPRVLELSLCLCAPLPALPPPLPHHSLCTPSSSPHITTTTTTFNFLGHIIPTYPLILRAQNHTHGLGARAGWTDTSPYPYPSRVWLENFCFLGFFFS

SEQ ID NO: 1024803 - protein, 195 aa, Homo sapiens; identical to SEQ ID NO: 1024798

SEQ ID NO: 1024804 - protein, 74 aa, Homo sapiens
MPLGLRAAFVCTRVKPHSHTCTHAHAHTRTRSYTLTHTCAHTHTRTHTFIHTLTRSHTRSHTHAHMVTGTHVLQ

SEQ ID NO: 1024805 - protein, 433 aa, Homo sapiens
MSSEDRHLGSSCGSFIKTEPSSPSSGIDALSHHSPSGSSDASGGFGMALGTHANGLDSPPMFAGAGLGGNPCRKSYEDCTSGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSENSPYLSLQISPPAKKPLTKIVSYLLVAEPDKLYAMPPDDVPEGDIKALTTLCDLADRELVFLISWAKHIPGFSNLTLGDQMSLLQSAWMEILILGIVYRSLPYDDKLAYAEDYIMDEEHSRLVGLLELYRAILQLVRRYKKLKVEKEEFVMLKALALANSDSMYIENLEAVQKLQDLLHEALQDYELSQRHEEPRRAGKLLLTLPLLRQTAAKAVQHFYSVKLQGKVPMHKLFLEMLEAKV

SEQ ID NO: 1024806 - protein, 125 aa, Homo sapiens
MSMKEVDEQMLNVQNKNSSYFVEWIPNNVKTAVCNIPPRGLKMSATFISNSTAIQELFKRISEQFTAMFRRKALLHWYTGEGMDEMEFTEAQSHMNDLVSEYQQYQDATADEQGEFEEEEGEDEA

SEQ ID NO: 1024807 - protein, 38 aa, Homo sapiens
LSDSGFYLCAWRQRYGYTFGSGTRLTVVEDLNKVFPPE

SEQ ID NO: 1024808 - protein, 44 aa, Homo sapiens
SSPRSQGTQHCISVPAARQDYGYTFGSGTRLTVVEDLNKVFPPE

SEQ ID NO: 1024809 - protein, 46 aa, Homo sapiens
SSPRSQGTQHCISVPAARQDWNQPQHFGDGTRLSILEDLNKVFPPE

SEQ ID NO: 1024810 - protein, 41 aa, Homo sapiens
SCPQNRETRHCISRQHIDGYTFGSGTRLTVVEDLNKVFPPE

SEQ ID NO: 1024811 - protein, 37 aa, Homo sapiens
HISLQRWCRDMDNYGYTFGSGTRLTVVEDLNKVFPPE

SEQ ID NO: 1024812 - protein, 33 aa, Homo sapiens
LCASSLMGGGWLHLRFGDQVNRCRGPEQGVPTR

SEQ ID NO: 1024813 - protein, 36 aa, Homo sapiens
FYICSPVPLRGDYGYTFGSGTRLTVVEDLNKVFPPE

SEQ ID NO: 1024814 - protein, 42 aa, Homo sapiens
ASTNQTSMYLCASSFSTENGYTFGSGTRLTVVEDLNKVFPPE

SEQ ID NO: 1024815 - protein, 31 aa, Homo sapiens
LCRGETSHGYTFGSGTRLTVVEDLNKVFPPE

SEQ ID NO: 1024816 - protein, 36 aa, Homo sapiens
CASSQETDIVWNQPQHFGDGTRLSILEDLNKVFPPE

SEQ ID NO: 1024817 - protein, 40 aa, Homo sapiens
LSDSGFYLCAWRQRWNQPQHFGDGTRLSILEDLNKVFPPE

SEQ ID NO: 1024818 - protein, 43 aa, Homo sapiens
SCPQNRETRHCISRQHTGNQPQHFGDGTRLSILEDLNKVFPPE

SEQ ID NO: 1024819 - protein, 51 aa, Homo sapiens
SCPQNRETRHCISRQHIRPGQRVGTLGSPLHFGNGTRLTVTRGPEQGVPTR

SEQ ID NO: 1024820 - protein, 44 aa, Homo sapiens
ASTNQTSMYLCASSFSTERNQPQHFGDGTRLSILEDLNKVFPPE

SEQ ID NO: 1024821 - protein, 35 aa, Homo sapiens
FAPAAPDRDGVDGYTFGSGTRLTVVEDLNKVFPPE

SEQ ID NO: 1024822 - protein, 34 aa, Homo sapiens
CASSYSAASGHGYTFGSGTRLTVVEDLNKVFPPE

SEQ ID NO: 1024823 - protein, 35 aa, Homo sapiens
LCASSGRLFRNQPQHFGDGTRLSILEDLNKVFPPE

SEQ ID NO: 1024824 - protein, 34 aa, Homo sapiens
YFCAGRQDHNSPLHFGNGTRLTVTRGPEQGVPTR

SEQ ID NO: 1024825 - protein, 114 aa, Homo sapiens
MNSFSSFSFITDVLFERGALHQHRVDCGSERNLRICSRALFSSQGRLPSCGAPRRRPPAASCTSCAGASAAPTRPPHSARPTLPNSAEPSSPPSPRAPTWCRARDLPGAMRRRS

SEQ ID NO: 1024826 - protein, 134 aa, Homo sapiens
MSSFSTTTVSFLLLLAFQLLGQTRANSMYNAVSNADLMDFKNLLDHLEEKMPLEDEVVPHKCSVSRMKKRGCSQPPPEVPSWTREAAQPREMEVPLGAPGPPLIDLPPKEAEALLTALGPRRPLSGQMQMPNGW

SEQ ID NO: 1024827 - protein, 114 aa, Homo sapiens
KSPEIIDMSHCAWPVITSLRSYSCVERHRTHRSNGNILHTQKETHTQTKPLFTSKEFLSHSCLIPCIQRSYFFPLITFILHWSDVFCFVCVCVSEFFRAQLSRGWSSVCHTGFS

SEQ ID NO: 1024828 - protein, 50 aa, Homo sapiens
MRLGSSKLRVKPAPSRSFEQNVEDPQPRKPTVPGAIDKLPMLPYPVILAI

SEQ ID NO: 1024829 - protein, 126 aa, Homo sapiens
MGLLEVRSQLKQEEEEEEAAAFSRAEHDKVSEEAESQQQWDTSKGEQVSQNGLPAEQGSPRMAETVDTSEMVNGATEQRTSSKESSPIPFPTSDRKPDCLPARVRTYSRPEHWPVEVLMEQVEPHR

SEQ ID NO: 1024830 - protein, 328 aa, Homo sapiens
MGLLEVRSQLKQEEEEEEAAAFSRAEHDKVSEEAESQQQWDTSKGEQVSQNGLPAEQGSPRMAETVDTSEMVNGATEQRTSSKESSPIPFPTSDRKAKIAFQAQMAATLPAGTKKTPSAQMEGFLNRKHEWEAHIMKASSRSWHKVNGDINNQERVLYKGAKTAASGIPYHSEVPVSLKEAVCEVALDYQRKHVFKLRLNDGSEYLFQAKDDEEMNTWIQAISSAISSDKHEVSASTQSTPASSRAQTLPTSVVTISRESSPGKREKDKEKDKEKRDSLKGQTEMNSFPSPPALVLPTPPKIRKQSSDTNTLNHMEEHQATESNVFGL

SEQ ID NO: 1024831 - protein, 224 aa, Homo sapiens
MNNTNQTKYTPQAKPGDRLLLRITKYTLTPDKIEKINNKNKTIQQKKYQNANNNTHQVRHTHKTTHTKRAKINTKHSNKQNTDKQHTTENDKTKTKIENKETNIRKTRVRHQKQRKRQQQMTNNNRATKKKQNRISEPTSRTKTRRTQHQTPRHTAQTKQRTQYAEKGQSNTGKKSDKHNRTKTNRREQMKQQDRERHNEQGREEQKTKKQKEGKNKYEDTRMH

SEQ ID NO: 1024832 - protein, 142 aa, Homo sapiens
PLSLTFRCLIAAIMGRMHAPGKGLSQSALPYRRSVPTWLKLTSDDVKEQIYKLAKKGLTPSQIGVILRDSHGVAQVRFVTGNKILRILKSKGLAPDLPEDLYHLIKKAVAVRKHLERNRKDKDAKFRLILIESRIHRCGSIL

SEQ ID NO: 1024833 - protein, 117 aa, Homo sapiens
PLSLTFRCLIAAIMGRMHAPGKGLSQSALPYRRSVPTWLKLTSDDVKEQIYKLAKKGLTPSQIGVILRDSHGVAQVRFVTGNKILRILKSRTALTSKAYINKNEVVGRLEGKRNGES

SEQ ID NO: 1024834 - protein, 195 aa, Homo sapiens
IISSGNITGAYTFLVNVLEQQDVKLLEEPMAGRQTQPKQKTEESDDEAAVEEEEEEKKPKINKVAQTVWDWELMNDIKPIWQRPSKEVEEDEYKAFYKSFSKESDDPMAYIHFTAEGEVPPNQFNLYHHLLHVVCLTSMDLKERYIKLYVRVYSSQTLHDMMPNTHLSGCVTQMISLNVPRSSQHITAKVIGELS

SEQ ID NO: 1024835 - protein, 67 aa, Homo sapiens
SQVGTGEENSPVQSVFDKGLGNPSLSYTCLIFAELFPGTDLFYCVVLPGPSKEVKENIMSEHLPGHV

SEQ ID NO: 1024836 - protein, 122 aa, Homo sapiens
VVTIRETALLIDPKISCSSSRQWVALVVGHELAHQWFGNLVTMEWWTHLWLNEGFASWIEYVCVDHCFPEYDIWTQFVSADYTRAQELDALDNSHPIEYYRLSASCHNPESHCLPGQCGPSI

SEQ ID NO: 1024837 - protein, 248 aa, Homo sapiens
MLNKQQSEDDVRRLFEAFGNIEECTILRGPDGNSKGCAFVKYSSHAEARPPFNALTRQPDHAGSLRPVWWSSFADTDKERTMRRMQQMVGQMGMFNPMAIPFGAYGAYAQALMQQQAALMASVAQGGYLNPMAAFAAAQMQQMAALNMIWAGSRTYDPNLSGSTPPGITAPAVPSIPSPMWVNGFTGLPLRPMGSVLRNVCPMIHRTQHRAPRQPTPCSRPTLELQSIEDVPSLLPMVRLARPFSDGE

SEQ ID NO: 1024838 - protein, 98 aa, Homo sapiens
ALPPRPSLESSSHGPTLPYGRGLNKGHKVTKNVSKPRHSERRGSVAKHTKFVRDMIPGRLCGFAPYERRAMELLKVSKDKPGPQIYQEKGGRTSGAKR

SEQ ID NO: 1024839 - protein, 129 aa, Homo sapiens
QILYGENIVKFRFSQQTAFQNDFTYTLTGFGTDFTHDVTVVVTDERVQVSNDTDRVVNVTFAHFFVSSDANLVERLQRIHFSISIAPEQPVNTFSVSRLALALAFDVTLTACSSTPPDQRPSDQTAPGT

SEQ ID NO: 1024840 - protein, 127 aa, Homo sapiens
MPSVSTLWAGGSLILTGGSVVYVKRVGDIEGCLAPSCVYREVKPRRTAPCRLVGLVEMEEEAIGLALGIQVGVVGEVHLASGLWELRKLLILLKMLQERGMYPWGQGITCPISKGLFSCCIPGRPSL

SEQ ID NO: 1024841 - protein, 36 aa, Homo sapiens
PLVGEVVVAPAATLRRRDPAALARRSSSRTRSRDQP

SEQ ID NO: 1024842 - protein, 528 aa, Homo sapiens
MPTPDATTPQAKGFRRAVSELDAKQAEAIMVRGQGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLSWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 1024843 - protein, 497 aa, Homo sapiens
MPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLSWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 1024844 - protein, 537 aa, Homo sapiens
HLCLFLLLSLFLLLLPKTFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRQLRGPCARDPDSVLQADAGPGGWEGRTKGRTHLVTSISASCQAALLQGFPCPQIPVGKLRPRGARATCRGHIAGSRHSQLGCTLLSILQPKGLAALGGCGPVPSEAPSLPPALLTPRGDLLTTGPLPSGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 1024845 - protein, 444 aa, Homo sapiens
DLHTEPCPPPTPPRHRPRASAGPCLSWTPSRQRPSWATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 1024846 - protein, 387 aa, Homo sapiens
DLHTEPCPPPTPPRHRPRASAGPCLSWTPSRQRPSWATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSELSAIG

SEQ ID NO: 1024847 - protein, 543 aa, Homo sapiens
MPTPDATTPQAKGFRRAVSELDAKQAEAIMVRGQGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQVRLRPRREPGVTQGWLGAGGGRGSMCGWVKCAACSRAPPRRLGAPRVARHRAGLERSLPRPVLPPAGYLGTAPTGLRIWSRRAAWRRRPGVGADPGRPGKVSAAREVSQRPLEGLLTPPVPPPRALTQGFASPPSFILPAPQDIGLASLGASDEEIEKLSTVG

SEQ ID NO: 1024848 - protein, 476 aa, Homo sapiens
DLHTEPCPPPTPPRHRPRASAGPCLSWTPSRQRPSWATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVKNDLGSITYFSLESARGFTESPSWFIHRQDFAMERMHGSRRGEDILK

SEQ ID NO: 1024849 - protein, 222 aa, Homo sapiens
LKGVARAASLVGRRRAGTGMALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRPRSSAFSWPGTHRATPAL

SEQ ID NO: 1024850 - protein, 251 aa, Homo sapiens
LKGVARAASLVGRRRAGTGMALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRPRSSAFSWPGTHRATPAFLVSPALRCLEPPHLANLTLEDAAECLKQH

SEQ ID NO: 1024851 - protein, 227 aa, Homo sapiens
LKGVARAASLVGRRRAGTGMALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHNLVSPALRCLEPPHLANLTLEDAAECLKQH

SEQ ID NO: 1024852 - protein, 122 aa, Homo sapiens
PFCMALAHLPQQPRPAPSAFSFYSACQNASAPPFKPALHLRARLAGTISIPIKLKNTALAWPGQAAHALGNRERGEPSPFCSWLFFGLWGGIHFQGRGGNTKCIVVLLNTSHLFLIKKAADP

SEQ ID NO: 1024853 - protein, 116 aa, Homo sapiens
HRGSSVHPPSSSEAPCRRWCQHCHRTEKGTEYKRLQPQLTATDSRAGPLLSTTALSRHQGQTKGKSNHKAGGTPCKPCTMVAACARHGALGCKAGCKVLCTGDVGGTRLLGSGDNR

SEQ ID NO: 1024854 - protein, 116 aa, Homo sapiens; identical to SEQ ID NO: 1024853

SEQ ID NO: 1024855 - protein, 92 aa, Homo sapiens
EVKHVCPNVPIILVGIRRIFGMMSTQGGSIAKMKQEPVKPEEGRDMANRIGACGYMECSAKTKDGVREVFEMATRAALQARRGKKKSGCLVL

SEQ ID NO: 1024856 - protein, 92 aa, Homo sapiens; identical to SEQ ID NO: 1024855

SEQ ID NO: 1024857 - protein, 2414 aa, Homo sapiens
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGTNAGMNPGMLAAGNGQGIMPNQVMNGSIGAGRGRQDMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPNAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPTAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQPQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 1024858 - protein, 1045 aa, Homo sapiens
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGTNAGMNPGMLAAGNGQGIMPNQVMNGSIGAGRGRQDMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPNAPLLPPQPATPLSQPAVSIEGQVSNPPSTSSTEVNSQAIAEKQPSQEVKMEAKMEVDQPEPADTQPEDISESKVEDCKMESTETEERSTELKTEIIQEVEAVVSYDSRHSSPAWVTQ

SEQ ID NO: 1024859 - protein, 75 aa, Homo sapiens
PPGVKENGADPTGPREKGNPPSRPPMGALPGHLMRSEPPAKNRTGTEPPQGERTKFCPQTHSSSTSHLSGPARVL

SEQ ID NO: 1024860 - protein, 104 aa, Homo sapiens
VSYLAERGCLEQGPSCTILNHHLVQQLWPQTTPWEQREDKKYRVHKYTSVCRQIIRFFVLSVESTTDDAGKKQKSCLALTCYDSMKTVMPHLPHLKTKSEYQNY

SEQ ID NO: 1024861 - protein, 155 aa, Homo sapiens
MLHHFVFYTMNLPNCIRYSVRCMCVFSSDSIPSLLILLVLCHSVCCLKLFFKLIFPNSFIIYEKLGLNPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 1024862 - protein, 52 aa, Homo sapiens
MICTGWNPRTLTGFCLDEALEPAPAKLDRPGFFKTLLGYSPSYYNLSGSYKR

SEQ ID NO: 1024863 - protein, 89 aa, Homo sapiens
RESGGAEEEEKADRLGPGSGRRGFPCSSWSETRPQCGNWRHHDLHWLEPKNPYWFLLDEALEPPPPKLDLTLLARSTSGFLWLLAPGLI

SEQ ID NO: 1024864 - protein, 406 aa, Homo sapiens
GVNCRRTLDVMSETNNEFLAALESAADQIKVGDVVTGELLAIDNDNQAVVGLSTGEEGVVPAREYSDDRNINLADELKIGDTIEAVVISNVTSDKEGVSYLLSKKRLDARKAWENLSFAEGDTVDAKVINAVRGGLIVDVNGVRGFVPASMVAERFVSDLNQFKNKDIKAQVIEIDPANARLILSRKAVAAQERAAQLAEVFSKLSVGEVVEGTVARLTDFGAFVDLGGVDGLVHVSEISHDRVKNPADVLTKGDKVDVKILALDTEKGRISLSIKATQRGPWDEAADQIAAGSVLEGTVKRVKDFGAFVEILPGIEGLVHVSQISNKRIENPSEVLKSGDKVQVKVLDIKPAEERISLSMKALEEKPEREDRRGNDGSASRADIAAYKQQDDSAATLGDIFGDKL

SEQ ID NO: 1024865 - protein, 92 aa, Homo sapiens
IEDGGGDLCRALPEESSCGQSQGHHVENFGLDSEKEKEPVVVEHSRKRNTGNLILVCPPFSEAAGIHTDLKDLQSRWGICTCKEGFGSHALS

SEQ ID NO: 1024866 - protein, 103 aa, Homo sapiens
MGHFTEEDKATITSLWGKVNVEDAGGETLVTWLHELRLPNGPYDGFFDKLMGIRMSSCLCTSLGNSQMSKATLATNGADFPWDDAMKMQAGLISQWHLRPMPE

SEQ ID NO: 1024867 - protein, 158 aa, Homo sapiens
MGHFTEEDKATITSLWGKVNVEDAGGETLGRLLVVYPWTQRFFDSFGNLSSASAIMGNPKVKAHGKRVLTSLGDAIKHLDDLKGTFAQLSELHCDKLHVDPETSSSWKCAGDRFGNPFRQRFTPEVAGFLAEDGDWRCQCLCPPDTTELTAYDCRLSR

SEQ ID NO: 1024868 - protein, 93 aa, Homo sapiens
MGHFTEEDKATITSLWGKVNVEDAGGETLEGSPGLFILWAPGFFYTSCAPCSVPVSSGNPKSETQQRWCILLSSLHAHVISEHSSIVITLTAA

SEQ ID NO: 1024869 - protein, 93 aa, Homo sapiens
GILDIAFLCCKILRTFSDISKFHHVRFGAGSAYDAPRVTSVLVTELGAAGHLSCGGSGTEFPGFGHVSAGRVEPHRQGALDSFSGFSLYVINR

SEQ ID NO: 1024870 - protein, 83 aa, Homo sapiens
LDRIVKESGGKLTRRLVNSQCEFERRKPDGTTTLGLLHPVDPIVGEPGYCPVRLGMTTGRLQSGVFTEEEFNNKDKRNKVTPV

SEQ ID NO: 1024871 - protein, 78 aa, Homo sapiens
LDRIVKESGGKLTRRLVNSQCEFERRKPDGTTTLGLLHPVDPIVGEPGTACETGIDNWRLSLGQYLQVVKEDKGPSHS

SEQ ID NO: 1024872 - protein, 59 aa, Homo sapiens
MSRALDVLQMKEDVLKFLAAGTHLGGTSLDFQMEKYISKRKSDGIYIINLKRTWEKLLL

SEQ ID NO: 1024873 - protein, 211 aa, Homo sapiens
WSQETPEACTAPKHWMLDKLTGVFAPRPSTGPHKLRECLPLIIFLRNRLKYALTGDEVKKICMQRFIKIDGKVRTDITYPAGFMDVISIDKTGENFRLIYDTKGRFAVSSYYTGEAKYKLCKVRKIFVGTKGIPHLVTHDARTIRYPDPLIKVNDTIQIDLETGKITDFIKFDTGNLCMVTGGANLGRIGVITNRERHAGSFDVVHVKDAN

SEQ ID NO: 1024874 - protein, 113 aa, Homo sapiens
MEPASAHLLLNDMIAGQHCLEVTIFICFSTSFCSSFSFSASSSISLTLDSSASGPQWRVPVTSTSPAPPPPLGCRGSRTSPGPGAPGGRGAGAAPLRARAPARAPAARPQAPP

SEQ ID NO: 1024875 - protein, 113 aa, Homo sapiens; identical to SEQ ID NO: 1024874

SEQ ID NO: 1024876 - protein, 33 aa, Homo sapiens
ASTNKTSCISLQQEDRVSSYEQYFGPGTRLTVT

SEQ ID NO: 1024877 - protein, 249 aa, Homo sapiens
MLQDVLEKPDLSLCTCEDFVVTDGTRQLASDACFHCSECKKLTGGKALCCQRRTKLLCTDCYSKEYSSKCQGNAKKTIMPGTRKMEYKGSSWHETCFICQRCQQTNWNQEFHPSKDNQNFCVPCYEKQHAMQAVQCNKAHHLGERVTYREQALDTKECFVLHTLTGTPAVWASASQTRDDFAYVTELLSVNLYCQASCAECTNPISGLAGPNNYILPVKNAPLPFKDCLNCSEVLPLMMKRDILHTDVP

SEQ ID NO: 1024878 - protein, 320 aa, Homo sapiens
EVEIHAGGFNQEPLLKRVNADANPRQYADTVKALRVRRLTVEAAQVPAQQLEGALRVLANSRLKELTLEDLKITGTMPPLPLEATELALSQLRLRNVSWATGRSWLAELQQWLKPGLKVLSIAQEHSPAFSCEQVRAFPALTSLDLSDNPGLGERGLMAAFCPHKFPAIQNLALRNTGMETPTGVCAALAAAGVQPHSLDLSHNSLRATVNPSAPRCMWSSALNSLNLSFAGLEQVPKELPAKLRVLDLSCNRLNRAPQPDELPEVDNLTLDGNPFLVPGTALPHEGSMNSGVVPACARSTLSVGVSGTLVQLQGARGFA

SEQ ID NO: 1024879 - protein, 102 aa, Homo sapiens
GFFPELGTSLSAMRFLAATFLLLALSTAAQAEPVQFKDCGSVDGVIKEVNVSPCPTPTLPAEQRTVLTASMSTFTSNIQSKSSKARGCMAILMGRPSSLSHS

SEQ ID NO: 1024880 - protein, 33 aa, Homo sapiens
ASTNQTSMYLCASSLFAANTGELFFGEGSRLTV

SEQ ID NO: 1024881 - protein, 32 aa, Homo sapiens
ASTNQTSMYLCASSLSQGRGGYTFGSGTRLTV

SEQ ID NO: 1024882 - protein, 31 aa, Homo sapiens
ASTNQTSMYLCASSLPGEDTQYFGPGTRLTV

SEQ ID NO: 1024883 - protein, 33 aa, Homo sapiens
ASTNQTSMYLCASSLPSSYNEQFFGPGTRLTVL

SEQ ID NO: 1024884 - protein, 32 aa, Homo sapiens
DSSIYLCSVGGTSPPSSYNEQFFGPGTRLTVL

SEQ ID NO: 1024885 - protein, 32 aa, Homo sapiens
ASTNQTSMYLCASSLSYGANVLTFGAGSRLTV

SEQ ID NO: 1024886 - protein, 30 aa, Homo sapiens
DSSFYICSARAASAANTGELFFGEGSRLTV

SEQ ID NO: 1024887 - protein, 33 aa, Homo sapiens
ASTNQTSMYLCASSLHGPTSYEQYFGPGTRLTV

SEQ ID NO: 1024888 - protein, 118 aa, Homo sapiens
TTSLYAVIMSERSFDFNSTHLRIYLEWKCQVILQKGFIFTIQFSFVQKWQGNIFISHSSLAFLILWAVSHLSRLPGYSLEPRSSVGQQQHNPLSHLLHCCLCHCSCAKTQRKNKKSNI

SEQ ID NO: 1024889 - protein, 109 aa, Homo sapiens
ACVCALAGSPGSFCHHAACFIAKHQRPASAARTGSSPLTQQLAQATGKPPQYIAVHVVPDQLMAFGGSSEPCALCSLHSIGKIGGAQNRSYSKLLCGLLARRLRFSPDR

SEQ ID NO: 1024890 - protein, 251 aa, Homo sapiens
GPQSRWRPEAARRAVPASVTEGRDQDECRAREEVACGGGVAERLVRMRDWRNPHPSSGPEPDGFVSKKGAREHGLSPADFFWRMLFPAKRWRSPISAVRAPAMRTTSGSSLMLASTSCVEYPMNVMWGAVRNCGELVSKKGKVCAEEHVELCDGGIRFPEKRSGGEGPCERVVLFKVARVKKRGCCFHDSGILAELLVPFWGVLCLHLEEEGIRLNDGVWKEEICWLGKGGNESLVKGGGKGRGVKLGKFG

SEQ ID NO: 1024891 - protein, 874 aa, Homo sapiens
SGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIGMENRNLHSPEYLEMALPLFCKAMSKLPLAAQGKLIRLWSKYNADQIRRMMETFQQLITYKVISNEFNSRNLVNEFNSRNLVNDDDAIVAASKCLKMVYYANVVGGEVDTNHNEEDDEEPIPESSELTLQELLGEERRNKKGLRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGLFVDLGDSHPVLYQSLKDLLEYVGNVEDDMMITFQISQTNLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 1024892 - protein, 120 aa, Homo sapiens
GQCGTGTGRKKEAREQGEKVHLASGPARNESMRCLPTPTTVFVPSAEGAPLGPEPCWGSTTLREEVRRIISAPRVSARGRLKHPCDLNILDRDEIQDWPHATNTKFAIEKIRPKHKKSKK

SEQ ID NO: 1024893 - protein, 153 aa, Homo sapiens
IPPHSRLYLQPPMAPKKPEPKKDDAKAAPKAAPAPAPPPEPERPKEVEFDASKIKIEFTPEQIEEFKEAFMLFDRTPKCEMRITYGQCGMSCGRWARTHTGRGAPCPGEPRQEELNTKMMDSETLLPMLSTFQTGQGPLGLVRARSERGNDLR

SEQ ID NO: 1024894 - protein, 152 aa, Homo sapiens
IPPHSRLYLQPPMAPKKPEPKKDDAKAAPKAAPAPAPPPEPERPKEVEFDASKIKIEFTPEQIEEFKEAFMLFDRTPKCEMRITYGQCGMSCGRWARTHTGRGAPCPGEPRQEELNTKMMDSETLLPMLQHISRSTDTGTYEDFVEAAGLRQ

SEQ ID NO: 1024895 - protein, 116 aa, Homo sapiens
YSHDCSDLRITTNAIGGIIESISDVRSVATFEMVVFVACGDTTVTYDMSEDTSEAKVKIPNTTVYCCQSTAGSAAVPIALKTFPFPGQTRAGTDPIYVQVRVSSSRISTFHQSVGS

SEQ ID NO: 1024896 - protein, 74 aa, Homo sapiens
GKSRMKNQNPPIPAGIRLTGKPKNLSQQNRPQPLTKGTKPAGLHQHREDFPQIRHIPKQGRKNKLCSDAYETPE

SEQ ID NO: 1024897 - protein, 345 aa, Homo sapiens
IQPGSPPAQRCPCSSGWRTEDRTLKPQVAEKPGVKMTERFDCHHCNESLFGKKYILREESPYCVVCFETLFANTCEECGKPIGCDCKDLSYKDRHWHEACFHCSQMQRNSPGGQALCCQGRTSCICTEHAIPTEYSSKCQECKKTIMPGTRKMEYKGSSWHETCFICHRCQQPNWNLRVSSPKTNQNFCVPCYEKQHAMQCVQCKKPITTGGVTYREQAWHKECFVCTDCRKQLSGQRFTARDDFAYCLNCFCDLYAKKCAGCTNPISGAWLAQEYISFGGTAVALTTALTVRSAPSHWWGRGSSPRATTILCPQMWEDLWFPPRSCVVSPPVFVSFPRTCFCSS

SEQ ID NO: 1024898 - protein, 438 aa, Homo sapiens
EKEEKYSQEQAGVNSAEEGTGRDRAARGGVHGNREACGAALPPLSPPTVRVIAQTWDLMCCANHPYTVSNTSTSVRGVYSDVVGHVCRRRSTRPAAEPQPPAARALQPRPGVPGPLRCRQVAEKPGVKMTERFDCHHCNESLFGKKYILREESPYCVVCFETLFANTCEECGKPIGCDCKDLSYKDRHWHEACFHCSQMQRNSPGGQALCCQGRTSCICTEHAIPTEYSSKCQECKKTIMPGTRKMEYKGSSWHETCFICHRCQQPNWNLRVSSPKTNQNFCVPCYEKQHAMQCVQCKKPITTGGVTYREQAWHKECFVCTACRKQLSGQRFTARDDFAYCLNCFCDLYAKKCAGCTNPISGAWLAQEYISFGGTAVALTNALTVRSAPSHWWGRGSSPRVTTILCPQMWEDLWFPPRSCVVSPPVFVSFPRTCFCSS

SEQ ID NO: 1024899 - protein, 310 aa, Homo sapiens
MTERFDCHHCNESLFGKKYILREESPYCVVCFETLFANTCEECGKPIGCDCKDLSYKDRHWHEACFHCSQMQRNSPGGQALCCQGRTSCICTEHAIPTEYSSKCQECKKTIMPGTRKMEYKGSSWHETCFICHRCQQPNWNLRVSSPKTNQNFCVPCYEKQHAMQCVQCKKPITTGGVTYREQAWHKECFVCTACRKQLSGQRFTARDDFAYCLNCFCDLYAKKCAGCTNPISGAWLAQEYISFGGTAVALTNALTVRSAPSHWWGRGSSPRVTTILCPQMWEDLWFPPRSCVVSPPVFVSFPRTCFCSS

SEQ ID NO: 1024900 - protein, 523 aa, Homo sapiens
EKEEKYSQEQAGVNSAEEGTGRDRAARGGVHGNREACGAALPPLSPPTVRVIAQTWDLMCCANHPYTVSNTSTSVRGVYSDVVGHVCRRRSTRPAAEPQPPAARALQPRPGVPGPLRCREYLLTHLLPRREAEGLSHQGSEVGAESGARPKERGAEPELGRLWLKTVSSWRLGWHFDFGQVAEKPGVKMTERFDCHHCNESLFGKKYILREESPYCVVCFETLFANTCEECGKPIGCDCKDKHGEPSHQTCPAQAFFFTFLFALGYLSYKDRHWHEACFHCSQMQRNSPGGQALCCQGRTSCICTEHAIPTEYSSKCQECKKTIMPGTRKMEYKGSSWHETCFICHRCQQPNWNLRVSSPKTNQNFCVPCYEKQHAMQCVQCKKPITTGGVTYREQAWHKECFVCTACRKQLSGQRFTARDDFAYCLNCFCDLYAKKCAGCTNPISGAWLAQEYISFGGTAVALTNALTVRSAPSHWWGRGSSPRVTTILCPQMWEDLWFPPRSCVVSPPVFVSFPRTCFCSS

SEQ ID NO: 1024901 - protein, 500 aa, Homo sapiens
EKEEKYSQEQAGVNSAEEGTGRDRAARGGVHGNREACGAALPPLSPPTVRVIAQTWDLMCCANHPYTVSNTSTSVRGVYSDVVGHVCRRRSTRPAAEPQPPAARALQPRPGVPGPLRCREYLLTHLLPRREAEGLSHQGSEVGAESGARPKERGAEPELGRLWLKTVSSWRLGWHFDFGGSAETAKEIRDMTERFDCHHCNESLFGKKYILREESPYCVVCFETLFANTCEECGKPIGCDCKDLSYKDRHWHEACFHCSQMQRNSLGGQALCCQGRTSCICTEHAIPTEYSSKCQECKKTIMPGTRKMEYKGSSWHETCFICHRCQQPNWNLRVSSPKTNQNFCVPCYEKQHAMQCVQCKKPITTGGVTYREQAWHKECFVCTACRKQLSGQRFTARDDFAYCLNCFCDLYAKKCAGCTNPISGAWLAQEYISFGGTAVALTNALTVRSAPSHWWGRGSSPRVTTILCPQMWEDLWFPPRSCVVSPPVFVSFPRTCFCSS

SEQ ID NO: 1024902 - protein, 310 aa, Homo sapiens; identical to SEQ ID NO: 1024899

SEQ ID NO: 1024903 - protein, 295 aa, Homo sapiens
EKEEKYSQEQAGVNSAEEGTGRDRAARGGVHGNREACGAALPPLSPPTVRVIAQTWDLMCCANHPYTVSNTSTSVRGVYSDVVGHVCRRRSTRPAAEPQPPAARALQPRPGVPGPLRCREYLLTHLLPRREAEGLSHQGSEVGAESGARPKERGAEPELGRLWLKTVSSWRLGWHFDFGTGVSLCRPWLECSGSDSQITASFYTLGSTPFILPQPPKELGLQVAEKPGVKMTERFDCHHCNESLFGKKYILREESPYCVVCFETLFANTCEECGKPIGCDCKVPAAGLCGSPALP

SEQ ID NO: 1024904 - protein, 426 aa, Homo sapiens
MVICGVHFVKKHLQGKKEKRPPCKYIPGTCLLRSDPLLPPPPPARPGASPVSRSWDQAEIPAWADPCHRAQASSETRAREPTPEATLPDNYCAPKTRRARRKEPWQTQVAEKPGVKMTERFDCHHCNESLFGKKYILREESPYCVVCFETLFANTCEECGKPIGCDCKDLSYKDRHWHEACFHCSQMQRNSPGGQALCCQGRTSCICTEHAIPTEYSSKCQECKKTIMPGTRKMEYKGSSWHETCFICHRCQQPNWNLRVSSPKTNQNFCVPCYEKQHAMQCVQCKKPITTGGVTYREQAWHKECFVCTACRKQLSGQRFTARDDFAYCLNCFCDLYAKKCAGCTNPISGAWLAQEYISFGGTAVALTNALTVRSAPSHWWGRGSSPRVTTILCPQMWEDLWFPPRSCVVSPPVFVSFPRTCFCSS

SEQ ID NO: 1024905 - protein, 481 aa, Homo sapiens
EKEEKYSQEQAGVNSAEEGTGRDRAARGGVHGNREACGAALPPLSPPTVRVIAQTWDLMCCANHPYTVSNTSTSVRGVYSDVVGHVCRRRSTRPAAEPQPPAARALQPRPGVPGPLRCREYLLTHLLPRREAEGLSHQGSEVGAESGARPKERGAEPELGRLQVAEKPGVKMTERFDCHHCNESLFGKKYILREESPYCVVCFETLFANTCEECGKPIGCDCKDLSYKDRHWHEACFHCSQMQRNSPGGQALCCQGRTSCICTEHAIPTEYSSKCQECKKTIMPGTRKMEYKGSSWHETCFICHRCQQPNWNLRVSSPKTNQNFCVPCYEKQHAMQCVQCKKPITTGGVTYREQAWHKECFVCTACRKQLSGQRFTARDDFAYCLNCFCDLYAKKCAGCTNPISGAWLAQEYISFGGTAVALTNALTVRSAPSHWWGRGSSPRVTTILCPQMWEDLWFPPRSCVVSPPVFVSFPRTCFCSS

SEQ ID NO: 1024906 - protein, 326 aa, Homo sapiens
MTGLCGYSAPDMRGLRLIMIPVELLLCYLLLHPVDATSYGKQTNVLMHFPLSLESQTPSSDPLSCQFLHPKSLPGFSHMAPLPKFLVSLALRNALEEAGCQADVWALQLQLYRQGGVNATQVLIQHLRGLQKGRSTERNVSVEALASALQLLAREQQSTGRVGRSLPTEDCENEKEQAVHNVVQLLPGVGTFYNLGTALYYATQNCLGKARERGRDGAIDLGYDLLMTMAGMSGGPMGLAISAALKPALRSGVQQLIQYYQDQKDANISQPETTKEGLRAISDVSDLEETTTLASFISEVVSSAPYWGWAIIKSYDLDPGAGSLEI

SEQ ID NO: 1024907 - protein, 223 aa, Homo sapiens
MSGSSSVAAMKKVVQQLRLEAGLNRVKVSQAAADLKQFCLQNAQHDPLLTGSIFKYKSLSDPRKSVPFCSNNESFKRFPKPLLMDPVNIQESSHFERLYQKLIPVTHVPYIYNLLLPSVLTIYLSELPPEISISPRGNLWLVYTGSSHTQKDNLRLVSQGLDQHKEPPRRHLLVSRVALTHNRRLNRNRGALTWAKNGVSPVPPTFFGSPQGVDELTPVMPRV

SEQ ID NO: 1024908 - protein, 114 aa, Homo sapiens
MKSPTGDQLSFPPVSSTWLSGLLQPHMQAEVKEEKIVPTSAHDQERYQRSFSSVTCAAHMVSWRRRCRDRWSEREKLRLQSVHRKGLMPVCLRKWRVSSSERANFQEQPSQVHL

SEQ ID NO: 1024909 - protein, 602 aa, Homo sapiens
EETIFVRRGSRCFLGSGYGRKDIGSNRGVPQGSWELEEPRTPPSSGFELLCPWVKRPCSACELLPGRAAMALRNVPFRSEVLGWDPDSLADYFKKLNYKDCEKAVKKYHIDGARFLNLTENDIQKFPKLRVPILSKLSQEINKNEERRSIFTRKPQVPRFPEETESHEEDNGGWSSFEEDDYESPNDDQDGEDDGDYESPNEEEEAPVEDDADYEPPPSNDEEALQNSILPAKPFPNSNSMYIDRPPSGKTPQQPPVPPQRPMAALPPPPAGRNHSPLPPPQTNHEEPSRSRNHKTAKLPAPSIDRSTKPPLDRSLAPFDREPFTLGKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQSASLPPYFSQGPSNRPPIRAEGRNFPLPLPNKPRPPSPAEEENSLNEEWYVSYITRPEAEAALRKINQDGTFLVRDSSKKTTTNPYVLMVLYKDKVYNIQIRYQKESQVYLLGTGLRGKEDFLSVSDIIDYFRKMPLLLIDGKNRGSRYQCTLTHAAGYP

SEQ ID NO: 1024910 - protein, 35 aa, Homo sapiens
MLITATALHESAPRKTSKPRGTFNFPGQVPLCATS

SEQ ID NO: 1024911 - protein, 36 aa, Homo sapiens
MGAFRPGAGQPPDEMIYCWKWRRFPATSDEEMSHCQ

SEQ ID NO: 1024912 - protein, 485 aa, Homo sapiens
MNPELTMESLGTLHGARGGGSGGGGGGGGGGGGGGPGHEQELLASPSPHHARRGPRGSLRGPPPPPTAHQELGTAAAAAAAASRSAMVTSMASILDGGDYRPELSIPLHHAMSMSCDSSPPGMGMSNTYTTLTPLQPLPPISTVSDKFHHPHPHHHPHHHHHHHHQRLSGNVSGSFTLMRDERGLPAMNNLYSPYKEMPGMSQSLSPLAATPLGNGLGGLHNAQQSLPNYGPPGHDKMLSPNFDAHHTAMLTRGEQHLSRGLGTPPAAMMSHLNGLHHPGHTQSHGPVLAPSRERPPSSSSGSQVATSGQLEEINTKEVAQRITAELKRYSIPQAIFAQRVLCRSQGTLSDLLRNPKPWSKLKSGRETFRRMWKWLQEPEFQRMSALRLAACKRKEQEPNKDRNNSQKKSRLVFTDLQRRTLFAIFKENKRPSKEMQITISQQLGLELTTVSNFFMNARRRSLEKWQDDLSTGGSSSTSSTCTKA

SEQ ID NO: 1024913 - protein, 111 aa, Homo sapiens
CVNCWKQGARGSFLQFMPFTPVWKLVKVSAMSSPKVVFAIQDLNLPLGRQVAVKPLLHSEGLGMPPVGAGDWRSPRRPPREAVRKDEASCLTSAPHGARASSGFQFPAPDS

SEQ ID NO: 1024914 - protein, 30 aa, Homo sapiens
TAVYYCARGCQHLVNYFDYWGQGTLVTVSS

SEQ ID NO: 1024915 - protein, 35 aa, Homo sapiens
TAVYYCARGYYDSSGYFAGYYFDYWGQGTLVTVSS

SEQ ID NO: 1024916 - protein, 31 aa, Homo sapiens
TAVYYCAREGDGGNLSYFDYWGQGTLVTVSS

SEQ ID NO: 1024917 - protein, 34 aa, Homo sapiens
TAVYYCARGGSYYYDSSGPYFDYWGQGTLVTVSS

SEQ ID NO: 1024918 - protein, 633 aa, Homo sapiens
VVVALSRPCHEQALNSSGLHVLRPPSSATLSSEFSFGLPRASNLVSEARSHNALRAAAPAEECVSPRSAYCVRRRGRAELPACRAGLAARVGAIAASASAAPPSPPPPGPFAAARGERGGAAGAAMEPDSVIEDKTIELMISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 1024919 - protein, 520 aa, Homo sapiens
MIRLPCKKPAEIDAITLGKAILPPPRVISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 1024920 - protein, 372 aa, Homo sapiens
MVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 1024921 - protein, 539 aa, Homo sapiens
LLKKAGYSKRKESWKMLDCCLFSDKSELENPHSFWIGGSEVQNIFQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 1024922 - protein, 542 aa, Homo sapiens
MEPDSVIEDKTIELMCSVPRSLWLGCANLVESMCALSCLQSMPSVRCLQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 1024923 - protein, 530 aa, Homo sapiens
MEPDSVIEDKTIELMNTSVMADPNEDESPNEHLLFGTISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 1024924 - protein, 137 aa, Homo sapiens
TKNAPTITTEQKTVNETIHYQGAGNQTPADNTAQVTSTRQVSTDTVTGEKSYGLGQLIKALGSDSPVIKGYYARSAEIGAQTVSGDASDLDFTVIYTKDAPTNPLIQVNQRRQQTRFRLVKRRLLILWTHSCLNLVN

SEQ ID NO: 1024925 - protein, 360 aa, Homo sapiens
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 1024926 - protein, 615 aa, Homo sapiens [sequence omitted]

SEQ ID NO: 1024927 - protein, 264 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPSACAVLSHPIFEIVPPTLRAQICRVNELWQLPPWGEISFGWRGERHAGFRTGGTGPFGRCPIGFFDLIDTWAVSTLSQRLHDSSNSREKHTK

SEQ ID NO: 1024928 - protein, 129 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPSERELREPMEIPVPAQIQTIVHRIAGRKRKKDTHETSQEPSLTE

SEQ ID NO: 1024929 - protein, 72 aa, Homo sapiens
CFFSCCSNASGSTRISGSERDCTDCFKKMADKPDMGEIASFDKAKLKKTETQEKNTLPTKETIEQEKRSEIS

SEQ ID NO: 1024930 - protein, 72 aa, Homo sapiens; identical to SEQ ID NO: 1024929

SEQ ID NO: 1024931 - protein, 72 aa, Homo sapiens; identical to SEQ ID NO: 1024929

SEQ ID NO: 1024932 - protein, 72 aa, Homo sapiens; identical to SEQ ID NO: 1024929

SEQ ID NO: 1024933 - protein, 72 aa, Homo sapiens; identical to SEQ ID NO: 1024929

SEQ ID NO: 1024934 - protein, 524 aa, Homo sapiens
MGAALLHPGAFLAPSLPRGPAGQTQLASPRAWWMPVDPVPSTPSAEASVLPDLLEWTPDSQETPGCRRGEKAGKVAGRGEGWAQESPGQAGGPGPPGPADHLVSGGGAHQGSGPGAKPPGPDNVSSSGVPATEGPTSEVTELRGAVGEESQETLMMNSDQKAVKFLANFYINGGKHWTHGHLRQTQPEPTQPKASVLLLGPEPGMAWDETQPPKMKEIPVGLRLQTGTPQESLPTYTQTLRELLLEQRLLITADLEVPSPTRYQVPSPSDTRALSNPHYSIGCKHQGREGGGRRAWQTLWFQSESPFTQKADFDQEQKASLQAPGKRCPGPNTYNILPGSRLQSPRSRLLDEPSPAFTSWLSTSRTPGPAAYHVEDCNSRFPSAPGVVIQGVRRPKRHDTGPFCTLYSQLGTTCLARPPSGTMASPGAFPGLPWDLGPQPGLLTLWAPRCTLLAGQPFYGLWTRLAQPGSPICPSPRYTEMLLVFPSSVVCSCLSVTRGRVLEIWLPAGSFPAFPVEGSPFSCP

SEQ ID NO: 1024935 - protein, 198 aa, Homo sapiens
MPWPQHLQYPSWEPPAEPPLAGFSMSRPLRSPPGSAPPEPLAQPPTTWRTATHASLRRLAWSSRVYADPSATTQAPSARSRASWAQPAWPGHRVETMASPGAFPGLPWDLGPQPGLLTLWAPRCTLLAGQPFYGLWTRLAQPGSPICPSPRYTEMLLVFPSSVVCSCLSVTRGRVLEIWLPAGSFPAFPVEGSPFSCP

SEQ ID NO: 1024936 - protein, 534 aa, Homo sapiens
MGAALLHPGAFLAPSLPRGPAGQTQLASPRAWWMPVDPVPSTPSAEASVLPDLLEWTPDSQETPGCRRGEKAGKVAGRGEGWAQESPGQAGGPGPPGPADHLVSGGGAHQGSGPGAKPPGPDNVSSSGVPATEGPTSEVTELRGAVGEESQETLMMNSDQKAVKFLANFYINGGKHWTHGHLRQTQPEPTQPKASVLLLGPEPGMAWDETQPPKMKEIPVGLRLQTGTPQESLPTYTQTLRELWGGGRRAWQTLWFQSESPFTQKADFDQEQKWPSPAHYQLLSRPAFPAFSFRGCHSLPRHLKANPPRAAWGQGAGPQGAAPVPASGLFAGTWQEMPWPQHLQYPSWEPPAEPPLAGFSMSRPLRSPPGSAPPEPLAQPPTTWRTATHASLRRLAWSSRVYADPSATTQAPSARSRASWAQPAWPGHRVETMASPGAFPGLPWDLGPQPGLLTLWAPRCTLLAGQPFYGLWTRLAQPGSPICPSPRYTEMLLVFPSSVVCSCLSVTRGRVLEIWLPAGSFPAFPVEGSPFSCP

SEQ ID NO: 1024937 - protein, 614 aa, Homo sapiens
MGAALLHPGAFLAPSLPRGPAGQTQLASPRAWWMPVDPVPSTPSAEASVLPDLLEWTPDSQETPGCRRGEKAGKVAGRGEGWAQESPGQAGGPGPPGPADHLVSGGGAHQGSGPGAKPPGPDNVSSSGVPATEGPTSEVTELRGAVGEESQETLMMNSDQKAVKFLANFYINGGKHWTHGHLRQTQPEPTQPKASVLLLGPEPGMAWDETQPPKMKEIPVGLRLQTGTPQESLPTYTQTLRELCEEGPGHPTPKLVFGGLWEGPAERSPGPELASLWPVLEQRLLITADLEVPSPTRYQVPSPSDTRALSNPHYSIGCKHQGREGGGRRAWQTLWFQSESPFTQKADFDQEQKWPSPAHYQLLSRPAFPAFSFRGCHSLPRHLKANPPRAAWGQGAGPQGAAPVPASGLFAGTWQEMPWPQHLQYPSWEPPAEPPLAGFSMSRPLRSPPGSAPPEPLAQPPTTWRTATHASLRRLAWSSRVYADPSATTQAPSARSRASWAQPAWPGHRVETMASPGAFPGLPWDLGPQPGLLTLWAPRCTLLAGQPFYGLWTRLAQPGSPICPSPRYTEMLLVFPSSVVCSCLSVTRGRVLEIWLPAGSFPAFPVEGSPFSCP

SEQ ID NO: 1024938 - protein, 319 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKSST

SEQ ID NO: 1024939 - protein, 130 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQM

SEQ ID NO: 1024940 - protein, 123 aa, Homo sapiens
YILRLVNVMNVISTVWPNSWLIRLKSSMTSCAVTGSNAATGSSAKRTLGFCVNVRANDTRLLLTTSQLISPTNALSNIDIRSSASKGESFLFWKSPTTGPNGYPNHDSSHFADSIVQRYRWKS

SEQ ID NO: 1024941 - protein, 267 aa, Homo sapiens
SVGLIELACSSWVFCGFLRYWSQAYTPATMSKGPAVGIDLGTTYSCVGVFQHGKVEDNLPMIRGNRTTSKLCLPLLDTERLIGDAAKNQVAMNPTNTVFDAKRLIGRRFDDAVVQSDMKHWPFMVVNDAGSAQVSKYEYNGRKTKSFYPEEVSSMVLTKDDMDIAGSLPWERLSTTAVVHSASLTFKLTLRRQAYQEMLELFLGLHVLSTLLVKPTAAAIAYGLDGKGLEQKETCSSLTWGGGHFLMLSILTIEGWKSFEGPRSYSL

SEQ ID NO: 1024942 - protein, 35 aa, Homo sapiens
MSKGPAVGIDLGTTYSCVIREPNHSKLCRLKTGLI

SEQ ID NO: 1024943 - protein, 584 aa, Homo sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 1024944 - protein, 96 aa, Homo sapiens
TLVRLETKAVENSMLGNQRAVQPDDRPHIPGQSAQLFIYQMSSPQLQQQPSANKYKQEKSKTTPFVNQLNSNADYVWKTFSANSSWRQSGSLTHHF

SEQ ID NO: 1024945 - protein, 67 aa, Homo sapiens
PVYAPGAYLALRLCVSYPPLSVSRDQTYCLGPSQLDKNEPRYRVTIMSLLTTLCICISQSTSPFSVM

SEQ ID NO: 1024946 - protein, 224 aa, Homo sapiens; identical to SEQ ID NO: 917137

SEQ ID NO: 1024947 - protein, 69 aa, Homo sapiens
AENTGKDGTSTHSLNSEKAEGSGMPRCRARPKPGSTTPGYMNKDKAGNPPDHSFLICQINTVIIAPHEM

SEQ ID NO: 1024948 - protein, 104 aa, Homo sapiens
FVYRTAVCIENSCMEKGVSKGETVRIHIFREIIRPAEKSLHESLNKIGALHPPQPTEAADLKSSYTPETDIIVPPMMLLGMLVRKESDTGQNALQTSFLSPTQG

SEQ ID NO: 1024949 - protein, 674 aa, Homo sapiens
MARAHWGCCPWLVLLCACAWGHTKPLDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIDTWESYDLALQGSNRQLVSITTNLVDLVWGSERPPVPNQPIYALQEAFTGSTWQEKVSGVRSQMQKHQKVPTAVLLSALEETAWLFNLRASDIPYNPFFYSYTLLTDSSIRLFANKSRFSSETLSYLNSSCTGPMCVQIEDYSQVRDSIQAYSLGDVRIWIGTSYTMYGIYEMIPREKLVTDTYSPVMMTKAVKNSKEQALLKASHVRDAVAVIRYLVWLEKNVPKGTVDEFSGAEIVDKFRGEEQFSSGPSFETISASGLNAALAHYSPTKELNRKLSSDEMYLLDSGGQYWDGTTDITRTVHWGTPSAFQKEAYTRVLIGNIDLSRLIFPAATSGRMVEAFARRALWDAGLNYGHGTGHGIGNFLCVHEWPVGFQSNNIAMAKGMFTSIEPGYYKDGEFGIRLEDVALVVEAKTKYPGSYLTFEVVSFVPYDRNLIDVSLLSPEHLQYLNRYYQTIREKVGPELQRRQLLEEFEWLQQHTEPLAARAPDTASWASVLVVSTLAILGWSV

SEQ ID NO: 1024950 - protein, 559 aa, Homo sapiens
SLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTG

SEQ ID NO: 1024951 - protein, 156 aa, Homo sapiens
QKRALSVHLHSDLQGLVQGSDSEAMMNNPGYESSPRERSARGHWYPYNERLICIYCGKSFNQKGSLDRHMRLHMGITPFVCKFCGKKYTRKDQLEYHIRGHTDDKPFRCEICGKCFPFQGTLNQHLRKTTHGVAEVRSRIESPERTDVYVEQKLGK

SEQ ID NO: 1024952 - protein, 147 aa, Homo sapiens
KEEEELVSLKDRIERRRAERAEQQRFRNEREKERQNRLAEERARREEEENRRKAEDEARKKKAFANNDEFWGYTQKQAQTERKRWKRQTEREKKKKTLLRGGRLSNSTVNRTTLGEAKGFADNYIFGRKSFPYERHHGRYAILLKGH

SEQ ID NO: 1024953 - protein, 288 aa, Homo sapiens
GDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALSLEFSQ

SEQ ID NO: 1024954 - protein, 316 aa, Homo sapiens
GDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRK

SEQ ID NO: 1024955 - protein, 508 aa, Homo sapiens
AEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVAYLQARGHSRSHSAWPDLQVPCPASHRLGARPASPAPQGSSMTDRHAGTYVGLPAGAASTLSTCRPHASRSLGVGGGHQPGFLTLGNKIFSPKKKKEKGAVACSGEPGRPLAFGYGGMTGRLVGGWGGRAAGAVGGSDGHAYEGGRPVITHKRRGARGEKIRGARPANIRLSGQERGEETRYHRPWRRGDSYNNGSPKTGGGPWSYSGGARTREAPGGSQGEVSATQY

SEQ ID NO: 1024956 - protein, 401 aa, Homo sapiens
MSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVAYLQARGHSRSHSAWPDLQVPCPASHRLGARPASPAPQGSSMTDRHAGTYVGLPAGAASTLSTCRPHASRSLGVGGGHQPGFLTLGNKIFSPKKKKEKGAVACSGEPGRPLAFGYGGMTGRLVGGWGGRAAGAVGGSDGHAYEGGRPVITHKRRGARGEKIRGARPANIRLSGQERGEETRYHRPWRRGDSYNNGSPKTGGGPWSYSGGARTREAPGGSQGEVSATQY

SEQ ID NO: 1024957 - protein, 380 aa, Homo sapiens
RVHLMLHVALHGALGQRTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVAYLQARGHSRSHSAWPDLQVPCPASHRLGARPASPAPQGSSMTDRHAGTYVGLPAGAASTLSTCRPHASRSLGVGGGHQPGFLTLGNKIFSPKKKKEKGAGACSGEPGRPLAFGYGGMTGRLVGGWGGRAAGAVGGSDGHAYEGGRPVITHKRRGARGEKIRGARPANIRLSGQERGEETRYHRPWRRGDSYNNGSPKTGGGPWSYSGGARTREAPGGSQGEVSATQY

SEQ ID NO: 1024958 - protein, 657 aa, Homo sapiens
NVQAGGMSLPRLLKVNIRTYDNSIPISESSRKSWNQKHFALTFPKPLQRGTNDKSRPLKSQITVTRHDKRKLEEGQKPAHKWIRHSFRKILQWPPIYTAAREQTPFRHLYTSKTHLKKAEYKKSKDEKGGTPLKKDSKKKGGSYATNPESKQIVEEKTKRQNEADKTPLKSSHENEQSKKSKSSSETNPESQNSKTVSKNCSQKDKKDSKNSKKTNTEFLHTKNNPKKDLKRSKTSNDPISEICSENSLNVDFLMLVGQSDDESINFDAWLRNYSQNNSKNYSLKYTKYTKKDTKKNAKKSSDAESEDSKDAKKDSKKVKKNVKKDDKKKDVKKDTESTDAESGDSKDERKDTKKDKKKLKKDDKKKDTKKYPESTDTESGDAKDARNDSRNLKKASKNDDKKKDAKKITFSTDSESELESKESQKDEKKDKKDSKTDNKKSVKNDEESTDADSEPKGDSKKGKKDEKKGKKDSKKDDKKKDAKKNAESTEMESDLELKKDKKHSKEKKGSKKDIKKDARKDTESTDAEFDESSKTGFKTSTKIKGSDTESEESLYKPGAKKKIDESDGTSANSKMEGLESKRGFRMSSKKTTFNEKGEKASTGRVPPSREKPPLPACEPSLPSPKVRRLCWCKMPPPPPKPRYAPLPEAPWIHKLL

SEQ ID NO: 1024959 - protein, 151 aa, Homo sapiens
SGSVSQAARRKMAVESRVTQEEIKKEPEKPIDREKTCPLLLQGLRPPITAATTELDEFLPGKMYRPASCMIYTWMDATLKKLTSLVEEVYPEARWKGSHFKFCNRFIQTVKQYLAIELKEIGSTMLAVRGDVTDSMTLQVAEVPDRRLLGH

SEQ ID NO: 1024960 - protein, 97 aa, Homo sapiens
RGELAECCARRGDGGLGQSLSKELLAEYQDLTFLTKQEILLAHRRFCELLPQEQRTWSRHFGHKFPSEQILSLPELKANPFKERICRVFFTFPAKDL

SEQ ID NO: 1024961 - protein, 173 aa, Homo sapiens
APFRSAICGGAATKMQIFVKTLTGKTITLEVEPSDTIENVKAKIQDKEGIPPDQQRLIFAGKQLEDGRTLSDYNIQKESTLHLVLRLRGGAKKRKKKSYTTPKKNKHKRKKVKLAVLKYYKVDENGKISRLRRECPSDECGAGVFMGSHFDRHYCGKCCLTYCFNKPEDKYTV

SEQ ID NO: 1024962 - protein, 153 aa, Homo sapiens
QDMQGPAVKLGRLVGYRETRLETQKPESGFLTDFVHSNEGIMQLEDGRTLSDYNIQKESTLHLVLRLRGGAKKRKKKSYTTPKKNKHKRKKVKLAVLKYYKVDENGKISRLRRECPSDECGAGVFMGSHFDRHYCGKCCLTYCFNKPEDKYTV

SEQ ID NO: 1024963 - protein, 125 aa, Homo sapiens
APFRSAICGGAATKMQIFVKTLTGKTITLEVEPSDTIENVKAKIQDKEGIPPDQQRLIFAGKQLEDGRTLSDYNIQKESTLHLVLRLRGGAKKRKKKSYTTPKKRSLVTIMRIRQSSLMMNMHLE

SEQ ID NO: 1024964 - protein, 43 aa, Homo sapiens
TAVYYCARDLLEQTTMRHIVAVPAAIYYYYMDVWGKGTTVTVS

SEQ ID NO: 1024965 - protein, 41 aa, Homo sapiens
MSGMEATVTIQSGKTGNMGLLECSKRLDHLPLSRVPGVLRP

SEQ ID NO: 1024966 - protein, 149 aa, Homo sapiens
GCGVRGFPPGKMTLETELWSLIYNKTGCNPKDTPWGKAPRMWWATHNVVCPVAQAGWATGCPRVPGSKPTSLNTVLPTLSLAPVDGGAPRLRDRVHLWDPPGPLSKLHGRGENLAQRLMRYWANFARTGDPNEPRDPKAPMAPYPGGSA

SEQ ID NO: 1024967 - protein, 78 aa, Homo sapiens
LAAGELRLPAQRPLPKRTAPFADVAPLQLKVRVKGVEPRVVPGTSQEVFEKTKRLLFLGAQATWTTCGMKAVLSFTCQ

SEQ ID NO: 1024968 - protein, 344 aa, Homo sapiens
RLGDSKAENRAEITVLVSDVNDNAPAFTQTSYTLFVRENNSPALHIGSVSATDRDSGINAQVTYSLLPPQDPHLPLTSLVSINADNGHLFALKSLDYEALQAFEFRVGATDRGSPALSSEALVRLLVLEANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPRSATATLHVLLVDGFSQPYLLLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLK

SEQ ID NO: 1024969 - protein, 465 aa, Homo sapiens
MPATPSLKVVHELPACTLCAGPLEDAVTVPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSGVITLDPQTASRSLVLSEDRKSVRYTRQKKSLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 1024970 - protein, 129 aa, Homo sapiens
HLVGQKVLDLLLPTEVSILHQHGTLDMFELDLPTVHSIISKMIINEEMASLDQPTQTVVMHRTEPTAQQNLALQLAEKLGTLVENNERVFDHKQGTYGGLLPENQKRYRKNEGLHASVGVTPSSSQRAY

SEQ ID NO: 1024971 - protein, 128 aa, Homo sapiens
PAARRRGAWAPPRAGASDSLHREAPPMPASSWGDSQNLLGPMNISIWGGAFPGHPSGGNLSLAPRTPGGLGPPLSASRPHSPPRVAGAGEEGASGLKTIKAGFFRDGQWSPEMEQRAPVAGIFSRSRL

SEQ ID NO: 1024972 - protein, 148 aa, Homo sapiens
NLKAQKFGRKAFGKHILGARPKQAGLELLTSGDPPTSASQGAGMTAVSHRAPPRSRGVLTGRLQASSDGREGIRAGVSSEMASGHLRWSREHLWRASSLEAACEPYGGPGLRAVRQTVSCRYVGEPCRQGLCLLSQNRTEEFGWGSPR

SEQ ID NO: 1024973 - protein, 140 aa, Homo sapiens
GGNNTVAPDYGHDLEPLGHTSLGKEDQVLTPRNWKWERQLLGSVELCLSLPCPSKDQEERNEPRSACQVSSEMASGHLRWSREHLWRASSLEAACEPYGGPGLRAVRQTVSCRYVGEPCRQGLCLLSQNRTEEFGWGSPR

SEQ ID NO: 1024974 - protein, 445 aa, Homo sapiens
MDLELDEYYNKTLATENNTAATRNSDFPVWDDYKSSVDDLQYFLIGLYTFVSLLGFMGNLLILMALMKKRNQKTTVNFLIGNLAFSDILVVLFCSPFTLTSVLLDQWMFGKVMCHIMPFLQCVSVLVSTLILISIAIVRYHMIKHPISNNLTANHGYFLIATVWTLGFAICSPLPVFHSLVELQETFGSALLSSRYLCVESWPSDSYRIAFTISLLLVQYILPLVCLTVSHTSVCRSISCGLSNKENRLEENEMINLTLHPSKKSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVFYRLTILILVFAVSWMPLHLFHVVTDFNDNLISNRHFKLVYCICHLLGMMSCCLNPILYGFLNNGIKADLVSLIHCLHM

SEQ ID NO: 1024975 - protein, 445 aa, Homo sapiens; identical to SEQ ID NO: 1024974

SEQ ID NO: 1024976 - protein, 231 aa, Homo sapiens
MDLELDEYYNKTLATENNTAATRNSDFPVWDDYKSSVDDLQYFLIGLYTFSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVFYRLTILILVFAVSWMPLHLFHVVTDFNDNLISNRHFKLVYCICHLLGMMSCCLNPILYGFLNNGIKADLVSLIHCLHM

SEQ ID NO: 1024977 - protein, 455 aa, Homo sapiens
MSFYSKQDYNMDLELDEYYNKTLATENNTAATRNSDFPVWDDYKSSVDDLQYFLIGLYTFVSLLGFMGNLLILMALMKKRNQKTTVNFLIGNLAFSDILVVLFCSPFTLTSVLLDQWMFGKVMCHIMPFLQCVSVLVSTLILISIAIVRYHMIKHPISNNLTANHGYFLIATVWTLGFAICSPLPVFHSLVELQETFGSALLSSRYLCVESWPSDSYRIAFTISLLLVQYILPLVCLTVSHTSVCRSISCGLSNKENRLEENEMINLTLHPSKKSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVFYRLTILILVFAVSWMPLHLFHVVTDFNDNLISNRHFKLVYCICHLLGMMSCCLNPILYGFLNNGIKADLVSLIHCLHM

SEQ ID NO: 1024978 - protein, 179 aa, Homo sapiens
STCPGAASMVHRNVISPHCRSAVEAHDVPRVDLVHDLQLADDLVRDGRLDLKVDQLPVHDEARGSVLDFGDHPRRCPRPALDPFEVIVFEFADLGFLGERSSSRFFCCSSSSSSSSFFCRSTEVSSEAPSLVGDGPSAMVGLMVDAGSDGFSGPASGSAGGGAAPLAGAIGGGPGAVRP

SEQ ID NO: 1024979 - protein, 191 aa, Homo sapiens
PYKLTHEILQPDYIATECFVTDSECTKSHCLSVQTGPLVKYSSDNFQAPSNYRYYPYQSSDSTTPQLPLPGQEGVLVPVYLPTIQSCWNYGFSCSSDELPVLGLTKSGGSDRTIAYENKALMLCEGLFVADVTDFEGWKAAIPSALDTNSSKSTSSFPCPAGHFQRLPHGHPPLLPDQLLRCGLDGVAQGW

SEQ ID NO: 1024980 - protein, 714 aa, Homo sapiens
GTPPVWSSPAKHCQESCEAAPAMCEEEDSTALVCDNGSWLCKAAFAGDDAPRAVFPSIVGRPRHQGVMVGMGQKDSYVGDEAQSKRGILTLKYPIEHGIITNWDDMEKIWHHSFYNELRVCPLKSIPPLTHGRHPLKPQRPNREKIDSKLLFEDFTMFPGHVMAHPRRLLSLMPLDAQHGYRAWTPGEWCHPQMSPSIEGYACAPMAIHESGIWAEPSISTVLTSMEDPGLYRGLFTFVYYCLSPENCPGTIKEKTVIMLALDFENEMATACILNPPFEKSYELPDGPSDHHRKLHTTPLPRDPVPVLPSSGMESAGVHESTYTQQIMKAVIIAITWTGHSTAEQTVPITGAPIYCTLGIARSIATRESLAYEPGDLKTRYTRLSRTLLTGLSVHLCLCPHAFDQQPTISPTDRDKTLGRCYQTVVETCINKHGRRHWGKSLVTLVRSRHSQRMSKTETDQAAHTATPRQATHQPQHNSSERSSTAASTDTQRSRAQPRQPTDGQRQANTTDHQHQDKALTCYSDYHITHTLISTSHSITLSKIDNNYDLNRHHIKEQNTQYTLICTHQLCNTSVLRMIQEQTKTATYTVHSMRTHRSIKYDKILDKPQNEAYKSPNTYIKEDELTRLRSGLTHSDRGKGYSRAGRTPKRASDASANQTEESPDRAHTERAAARRAAMHASVQTDQEEKRKRASRDPESRSHRNRHNERYREYG

SEQ ID NO: 1024981 - protein, 541 aa, Homo sapiens
EHHQCGAAQPSTVRNPVKQLQLCVSLMPSGTHNMAIVLGLLENGVTHNVPIYEGYACAPMAIHESGIWLAEDLNCTYLMEDPGLYRGLFTFVYYCLSPENCPGTIKEKTVIMLALDFENEMATACILNPPFEKSYELPDGPSDHHRKLHTTPLPRDPVPVLPSSGMESAGVHESTYTQQIMKAVIIAITWTGHSTAEQTVPITGAPIYCTLGIARSIATRESLAYEPGDLKTRYTRLSRTLLTGLSVHLCLCPHAFDQQPTISPTDRDKTLGRATKTVVETCINKHGRRHWGKSLVTLVRSRHSQRMSKTETDQAAHTATPRQATHQPQHNSSERSSTAASTDTQRSRAQPRQPTDGQRQANTTDHQHQDKALTCYSDYHITHTLISTSHSITLSKIDNNYDLNRHHIKEQNTQYTLICTHQLCNTSVLRMIQEQTKTATYTVHSMRTHRSIKYDKILDKPQNEAYKSPNTYIKEDELTRLRSGLTHSDRGKGYSRAGRTPKRASDASANQTEESPDRAHTERAAARRAAMHASVQTDQEE

SEQ ID NO: 1024982 - protein, 159 aa, Homo sapiens
MAKQHGKHPDTALAQNRKARHDYAVEETYEAGIALTGTEIKIRFAIGGSTLKDGFVSSFATVEAWMQNVHIESRLKRVNRYNVDPLRSRKLLLHKKEISKLGAATMTKGVTIIPLKMYLKHGFAKVLIGVAHGKREYDKRQDIKKREQQRQIDRVMKHY

SEQ ID NO: 1024983 - protein, 107 aa, Homo sapiens
GQFENLTPELPFEPNQEVPVAPSQSRQDLTDELAQKLFDVSEITSAAMVHSLPTAVPESPRIHPTRTPKTPRTPRLQDPNKTPRFYPVVKEPKAIDVKESKKEKNKA

SEQ ID NO: 1024984 - protein, 72 aa, Homo sapiens
ALNVLLDELLAVVGQIQVAVAEPEYFVAQQIAPNTFSAEGQQFLLVRHDVSLRVDRARPKQPVARRQGPILH

SEQ ID NO: 1024985 - protein, 415 aa, Homo sapiens
HERRSWWSERFPGEEMCKVPALASTPSSTQDSGGLLRPRSSGSRALAPPWDGAAASPPDLSRALLPQYWSAELNSGHFAFPQPVLTAKGTMTASSVLLHTGQKMPLIGLGTWKSEPGQVKAAIKHALSAGYRHIDCASVYGNETEIGEALKESVGSGKAVPREELFVTSKLWNTKHHPEDVEPALRKTLADLQLEYLDLYLMHWPYAFERGDNPFPKNADGTVRYDSTHYKETWKALEVLVAKGLVKALGLSNFNSRQIDDVLSVASVRPAVLQVECHPYLAQNELIAHCHARGLEVTAYSPLGSSDRAWRHPDEPVLLEEPVVLALAEKHGRSPAQILLRWQVQRKVICIPKSINPSRILQNIQVFDFTFSPEEMKQLDALNKNWRYIVPMITVDGKRVPRDAGHPLYPFNDPY

SEQ ID NO: 1024986 - protein, 210 aa, Homo sapiens
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDYGLGSGAPELGILGKKPLVFNSAFPCPIVSTIPILHAIPLEKKRRCGPNMIWEAVDPKSGKRVPPGCPPRQVSLQHM

SEQ ID NO: 1024987 - protein, 201 aa, Homo sapiens
MSGYSSDRDRGRDRGFGAPRFGGSRAGPLSGKKFGNPGEKLVKKKWNLDELPKFEKNFYQEHPDLARRTAQEVETYRRSKEITVRGHNCPKPGKGGGGEGGEGGGDARQNFTEPTAIQAQGWPVALSGGGGGGVQTSKTLSYFLPSIHINHQPFLGPIFVLAPTRELAQQVQQVAAEYCRCRLKSTCIYGGAPKGHKYVIW

SEQ ID NO: 1024988 - protein, 619 aa, Homo sapiens [sequence omitted]

SEQ ID NO: 1024989 - protein, 671 aa, Homo sapiens [sequence omitted]

SEQ ID NO: 1024990 - protein, 612 aa, Homo sapiens
MRPRRLGRCCAGSRLGPGDPAALTCAPSPSASPAPEPSAQPQARGTGQRVGSRATSGTQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEEVCTAFLIQLLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMYGAETEKLQKQLASEKEIQMQLQEEETLPGFQETLAEELRTSLRRMISDPVYFMERNYEMPRGDTSSLRYDFRYSEDREQVRGFEAEEGLMLAADIMRGEDFTPAEELVPQEELGAAKKVPAEEGVMEEAELVSEETEGWEEVELELDEATRMNVVTSALEASGLGPSHLDMNYVLQQLANWQDAHYRRQLRWKMLQKEPQPWT

SEQ ID NO: 1024991 - protein, 554 aa, Homo sapiens
MRPRRLGRCCAGSRLGPGDPAALTCAPSPSASPAPEPSAQPQARGTGQRVGSRATSGTQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEEVCTAFLIQLLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMYGAETEKLQKQLASEKEIQMQLQEEETLPGFQETLAEELRTSLRRMISDPVYFMERNYEMPRGDTSSLRYDFRYSEDREQVRGFEAEEGLMLAADIMRGEDFTPAEELVPQEELGAAKKQLANWQDAHYRRQLRWKMLQKEPQPWT

SEQ ID NO: 1024992 - protein, 602 aa, Homo sapiens
MRPRRLGRCCAGSRLGPGDPAALTCAPSPSASPAPEPSAQPQARGTGQRVGSRATSGTQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEEVCTAFLIQLLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMETLPGFQETLAEELRTSLRRMISDPVYFMERNYEMPRGDTSSLRYDFRYSEDREQVRGFEAEEGLMLAADIMRGEDFTPAEELVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 1024993 - protein, 627 aa, Homo sapiens
MRPRRLGRCCAGSRLGPGDPAALTCAPSPSASPAPEPSAQPQARGTGQRVGSRATSGTQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEEVCTAFLIQLLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRMYGAETEKLQKQLASEKEIQMQLQEEETLPGFQETLAEELRTSLRRMISDPVYFMERNYEMPRGDTSSLRYDFRYSEDREQVRGFEAEEGLMLAADIMRGEDFTPAEELVPQEELGAAKKVPAEEGVMEEAELVSEETEGWEEVELELDEATRMNVVTSALEASGLGPSHLDMNYVLQQLANWQDAHYRRQLRWKMLQKGECPHGALPAASRTSCRSSCR

SEQ ID NO: 1024994 - protein, 458 aa, Homo sapiens
MRPRRLGRCCAGSRLGPGDPAALTCAPSPSASPAPEPSAQPQARGTGQRVGSRATSGTQFLSEARTGARPASEAGAKAGARRPSAFSAIQGDVRSMPDNSDAPWTRFVFQGPFGSRATGRGTGKAAGIWKTPAAYVGRRPGVSGPERAAFIRELEEALCPNLPPPVKKITQEDVKVMLYLLEEVCTAFLIQLLPPVWESVTYGMVLQRERDLNTAARIGQSLVKQNSVLMEENSKLEALLGSAKEEILYLRHQVNLRDELLQLYSDSDEEDEDEEEEEEEKEAEEEQEEEEAEEDLQCAHPCDAPKLISQEALLHQHHCPQLEALQEKLRLLEEENHQLREEASQLDTLEDEEQMLILECVEQFSEASQQMAELSEVLVLRLENYERQQQEVARLQAQVLKLQQRCRIFGAQTEKLQQQLASEKGVHPESLRAGSHMQDYGSRPRERQEDGKSHRQRS

SEQ ID NO: 1024995 - protein, 77 aa, Homo sapiens
IELLTCCNATVEEIEALMKAVTSIYNLLCTKVEQQESKRTWGPGLANPLFREWGSPAGTATPSSERRHPESDPSFGI

SEQ ID NO: 1024996 - protein, 119 aa, Homo sapiens
RKQFFWDKVDSPKILGTEDMLWRKVFNFRLASEFIGNELAIKKLHSWLKDWKRRAELEERQNLKGKRDEKHEDFSGGIDFKGSSDDEEESRLCNTVPYNRANRSGKNCCSVCLCPGAWI

SEQ ID NO: 1024997 - protein, 209 aa, Homo sapiens
RKQFFWDKVDSPKILGTEDMLWRKVFNFRLASEFIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPKKISSPKKVVTSPRKVPPPSPKSSGPKRALPPKTLAKLF

SEQ ID NO: 1024998 - protein, 82 aa, Homo sapiens
AEEMLERVETLIRFHPGAQTLAGAAAAMDDREDLVYQAKWPEQAERYDEMVESMKKVAGMDVELTVEERNLLSVAYKNVIGA

SEQ ID NO: 1024999 - protein, 70 aa, Homo sapiens
MSRSLARSGLQLPAFVSELGMYLEVFVVFDFWERVWRRIGTSFTLKVFGQNSSGPLDVFIALLSIDPRYL

SEQ ID NO: 1025000 - protein, 143 aa, Homo sapiens
EVRTHAEIKAFSTQMSINGGQRLALKANIAGATDVKWVLTGVELTNSEEYRYGVSGSDQTLTIKQASHRDEGLLTCISKTKGGIVKVSVFFDTYQELSGAPAFTYSLDSNIMRQMSLLWNQCDTLNRWLNTAILSQCASVEVT

SEQ ID NO: 1025001 - protein, 229 aa, Homo sapiens
IQLKETSRQGVKTRSHWQGAAPSRRCGGHDGVLASALGRYERRSDSAQTLAGSAEPSGLGAPARGLRAGEPRAERGRSPGRRPTPPPAPRPGRPGPSAAGTALNLFEAPLRASRAGDCGSDSCVPAVGATSCGKQGKTTLVRRSSCLSPFVGDQHLVRMITISNRDPKPSHQGTSRVTITLTLNLGLLHFSAGCVNVRDPQLQAAVSWRNWTTATGWGSAVGDGTGRGR

SEQ ID NO: 1025002 - protein, 71 aa, Homo sapiens
MITISNRDPKPSHQGTSRVTITLTLNLGLLHFSAGCVNVRDPQLQAAVSWRNWTTATGWGSAVGDGTGRGR

SEQ ID NO: 1025003 - protein, 251 aa, Homo sapiens
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKSAPSSRSRSLTLLPHGTPNSASPCSQRHLSVGAPGVVTITHHKSPAAARRAKSQYSGQLHEVREMMNQVEGQ

SEQ ID NO: 1025004 - protein, 251 aa, Homo sapiens; identical to SEQ ID NO: 1025003

SEQ ID NO: 1025005 - protein, 158 aa, Homo sapiens
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRGAFFSQ

SEQ ID NO: 1025006 - protein, 99 aa, Homo sapiens
PRFLQFPNLTSIVIQVLESAPSSRSRSLTLLPHGTPNSASPCSQRHLSVGAPGVVTITHHKSPAAARRAKSQYSGQLHEVREVHTLLTEESCLLHWFTG

SEQ ID NO: 1025007 - protein, 260 aa, Homo sapiens
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKSAPSSRSRSLTLLPHGTPNSASPCSQRHLSVGAPGVVTITHHKSPAAARRAKSQYSGQLHEVREVHTLLTEESCLLHWFTG

SEQ ID NO: 1025008 - protein, 526 aa, Homo sapiens
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSTKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTFSGPLRPFFCLWSSGKKPLTICPIADGPERVTVIANAQDLSKEIPLSPMGEESAPRDADTLHSKLIPTQPSQGAP

SEQ ID NO: 1025009 - protein, 568 aa, Homo sapiens
MTVLEITLAVILTLLGLAILAILLTRWARRKQSEMYISRYSSEQSARLLDYEDGRGSRHAYQHKVTLHMITERDPKRDYTPSTNSLALSRSSIALPQGSMSSIKCLQTTEEPPSRTAGAMMQFTALFPELQDLSSSLKKPLCKLQDLLYNIWIQCQIASHTITGHLQHPRSPMAPIIISQRTASQLAAPIRIPQVHTMDSSGKITLTPVVILTGYMDEELRKKSCSKIQILKCGGTARSQIAEKKTRKQLKNDIIFTNSVESLKSAHIKEPEREGKGTDLEKDKIGMEVKVDSDAGIPKRQETQLKISEDEYTTRTGSPNKEKCVRCTKRTGVQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRRRQIQEGSTTKKWKSKDKFFKGP

SEQ ID NO: 1025010 - protein, 115 aa, Homo sapiens
PETSNSQTEARTLASSMKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 1025011 - protein, 263 aa, Homo sapiens
MGAAVLFRSALSSQFGPAFALFLITVAGDPLRVIILVAGAFFWLVSLLLASVVWFILVHVTDRSDARLQYGLLILGAAVSVLLQEVFRFAYYKLLKKADEGLASLSEDGRSPISIRQMAYVSGLSFGIISGVFSVINILADALGPGVVGIHGDSPYYFLTSALSDRQHICSITLGVCLDAVKKRTAGLGGRHNRMDEFLNLGRGHRAIKQPRYRGAGPHTWRTPQLGTLGTERKREGNRRTPERTGRGGQYPQPKGDGKENRE

SEQ ID NO: 1025012 - protein, 177 aa, Homo sapiens
MGAAVLFRSALSSQFGPAFALFLITVAGDPLRVIILVAGAFFWLVSLLLASVVWFILVHVTDRSDARLQYGLLILGAAVSVLLQEVFRFAYYKLLKKADEGLASLSEDGRSPISIRQMAYVSGLSFGIISGVFSVINILADALGPGVVGIHGDSPYYFLTSALSDSSHYPAPYLLGH

SEQ ID NO: 1025013 - protein, 131 aa, Homo sapiens
RKWRGPSFGVSVPPLPLPRGLGVTLHRAPRGVACHPTRTPQLARPSHLPVWSGPHPPSHLTSHGGCGVISAALSSQFGPAFALFLITVAGDPLRVIILVAGAFFWLVSLLLASVVWFILVHVTDRSDARLQ

SEQ ID NO: 1025014 - protein, 510 aa, Homo sapiens
IANQDGSFYFMEMNTRLQVEHPVTEMITGQDLVEWQLRVAAGEPLPLSQEQLRIDGHALEARVYARIPDKQFLPSTGTLRTDLRDAVRVSYAGEDVHAAVDVASRMDTIDISYLISPYYDPLIAKLIVWGKDRDELARMRQALAAYLVVGLSTNIAFLQRLVASEPFARADLDTGLIARHEATLFAATGAVGMELIALAEAALLDAEHARRDRCRGSTLAMDPCRPVAAEPGAQRVLFAHGTDTLEVTLQAHAQGSTLFYADQAAPFRTHCVRPTDGPGRSRHAPARNGQVHRDAEFFHVFAGGRTSRWNGRTRGAGRSGGYVDILVLDREFMSTNTINSTTTSAIPSANLPLWSTGATVTRTPLLVMSDEDEHTISARTASSAKCCMGSATRSAKASSCSASRPRRVELRGQGVRYLRCEMQDSLAFPQSRLRRRVDNGPMPCLREAGAPGAPPDIEPTASALGFPGAGAIGRSAPDRMASRHEEILYRHILSFPCPDHPRRLRTAAMQ

SEQ ID NO: 1025015 - protein, 498 aa, Homo sapiens
IANQDGSFYFMEMNTRLQVEHPVTEMITGQDLVEWQLRVAAGEPLPLSQEQLRIDGHALEARVYARIPDKQFLPSTGTLRTDLRDAVRVSYAGEDVHGPAGVRIDSGVREGDAISPYYDPLIAKLIVWGKDRDELARMRQALAAYLVVGLSTNIAFLQRLVASEPFARADLDTGLIARHEATLFAPPARSAMELIALAEAALLDAEHARRDRCRGSTLAMDPCRPVAAEPGAQRVLFAHGTDTLEVTLQAHARGQARCSMPTRPRRSARIAFGRRNGPGRSRHAPARNGQVHRDAEFFHVFAGGRTSRWNGRNPWRKRAMPKSRCGKLTAPMPGKVIAVMVEPARRHRHAHAAAVMSDEDEHTISARTASSAKCCMGSATRSAKASSCSASRPRRVELRGQGVRYLRCEMQDSLAFPQSRLRRRVDNGPMPCLREAGARVPPPDIEPTASALGFPGAGAIGRSAPDRMASRHEEILYRHILSFPCPDHPRRLRTAAMQ

SEQ ID NO: 1025016 - protein, 82 aa, Homo sapiens
GVLAIRPDELRFRYSMVAYLRQAWTQLHPILPDLCKSSVEMHLRQNSKQMLRRLLQQRKIDEVRGLFTPTKLECYIPGKCLA

SEQ ID NO: 1025017 - protein, 117 aa, Homo sapiens [sequence omitted]

SEQ ID NO: 1025018 - protein, 172 aa, Homo sapiens
MCKGLAALPHSCLERAKEIKIKLGILLQKPDSVGDLVIPYNEKPEKPAKTQKTSLDEALQWRDSLDKLLQNNYGLAVSKSFLKSEFSEENLEFWIACEDYKKIKSPAKDGEKGKHIYEEFIQTEVLKKVNIDHFTKDITMKNLVEPSLSSFDMAQKRIHALMEGFSASVCAL

SEQ ID NO: 1025019 - protein, 115 aa, Homo sapiens
PVERKSLPEGRWRQRRERMNNKFDALKDDDSGDHDQNEENSTQKDGEKEKTERDKNQSSSKRKAVVPGPAEHPLQYNYTFWYSRRTPGVPRAHRSYEQNIKQIGTFASVEQFWRF

SEQ ID NO: 1025020 - protein, 155 aa, Homo sapiens
YAPRRVVFQDDSLELKWDSDNDEENEDVPISMKELKPFTEKKDKKLDDISSNYTESFSTLDENDLLNPSEDIIAVQLKFRACLKILTVELRTLSTGYEIDGGKLRYQLYHWLEKEVIALQRTCDFCSDAEELQSAFGRNEDEFGLNEDAEDLPHQ

SEQ ID NO: 1025021 - protein, 1453 aa, Homo sapiens
MMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPMHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSTAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGRLALILSSIFGLLLPVLFILFLTWCRVQKQKHLPLRVSTRRRGSLEENLFHEMETCLKREDPHGTRTSDDTPNHGCEDASDTSLLGVLPASEATK

SEQ ID NO: 1025022 - protein, 1453 aa, Homo sapiens; identical to SEQ ID NO: 1025021

SEQ ID NO: 1025023 - protein, 1461 aa, Homo sapiens
DSGRDRPIMMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPMHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 1025024 - protein, 1410 aa, Homo sapiens
DSGRDRPIMMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPMHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRGESPTRIV

SEQ ID NO: 1025025 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPNGSAGPPGFPGAPGPKGEIGAVGNAGPTGPAGPRGEVGLPGLSGPVGPPGNPGANGLTGAKGAAGLPGVAGAPGLPGPRGIPGPPGAAGTTGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPVGARGEPGNIGFPGPKGPTGDPGKNGDKGHAGLAGARGAPGPDGNNGAQGPPGPQGVQGGKGEQGPAGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAHGAVGAPGPAGATGDRGEAGAAGPAGPAGPRGSPGERGEVGPAGPNGFAGPAGAAGQPGAKGERGGKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGFKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMEAIKVYCDFPTGETCIRAQPENIPAKNWYRSSKDKKHVWLGETINAGSQFEYNVEGVTSKEMATQLAFMRLLANYASQNITYPCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 1025026 - protein, 1366 aa, Homo sapiens; identical to SEQ ID NO: 1025025

SEQ ID NO: 1025027 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPNGSAGPPGFPGAPGPKGEIGAVGNAGPTGPAGPRGEVGLPGLSGPVGPPGNPGANGLTGAKGAAGLPGVAGAPGLPGPRGIPGPPGAAGTTGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPVGARGEPGNIGFPGPKGPTGDPGKNGDKGHAGLAGARGAPGPDGNNGAQGPPGPQGVQGGKGEQGPAGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAHGAVGAPGPAGATGDRGEAGAAGPAGPAGPRGSPGERGEVGPAGPNGFAGPAGAAGQPGAKGERGGKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGFKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMEAIKVYCDFPTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADHEFFVDIGPVCFK

SEQ ID NO: 1025028 - protein, 493 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPNGSAGPPGFPGAPGPKGEIGAVGNAGPTGPAGPRGEVGLPGLSGPVGPPGNPGANGLTGAKGAAGLPGVAGAPGLPGPRGIPGPPGAAGTTGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGPWDPEVFLVPLEISAPLEKKVLSASLASTAGIKEIHGRARWLMSVVPA

SEQ ID NO: 1025029 - protein, 78 aa, Homo sapiens
SQITPYMRVCMRELTHTHTHSPAPSSVLWFRLGPDLMGLVKKGMVGAPEAFALFLPPGDLLSIGNSKQADIQRASTLI

SEQ ID NO: 1025030 - protein, 78 aa, Homo sapiens; identical to SEQ ID NO: 1025029

SEQ ID NO: 1025031 - protein, 92 aa, Homo sapiens
MGSGRDGGGDMNAPPAFESFLLFEGEKKITINKDTKVPNACLFTINKEDHTLGNIINITLHKDPQVLFAGYKSPTLEQVIIRSATRLNPGAY

SEQ ID NO: 1025032 - protein, 192 aa, Homo sapiens
MGSGRDGGGDMNAPPAFESFLLFEGEKKITINKDTKVPNACLFTINKEDHTLGNIINITLLNRPASAICWLQESPSPVGAQRSSIRVQTRRLVRTARLRDRPLTKAITDLISELSLLEDRFRVVIIRQAGMELDVGATREALFEPVSPVPICALTLRSSVPTCEESWYASTGHGPAVVVIRLTLTPTCSVHR

SEQ ID NO: 1025033 - protein, 82 aa, Homo sapiens
VDYNSEHEDLGVDQKSPNPYNPKIPIPKKQCPVPLKTRDVKEPREVGGMTRGRGMKDKRKSMKTKCTSQVFACNKKKKEIKG

SEQ ID NO: 1025034 - protein, 241 aa, Homo sapiens
RYTPPQFSIVMEYCELLTLRELLDRGKDLTLGKRMVLVLGAARGLYRLHHSEAPELHGKIRSSNFLVTQGYQVKIWVTWLSLGLAAFSTPMVSMAGVRGTRTYAVMIVLQFLEEHQLAGFELRKTQTSMSLGTTREKTDRVKSTAYLSPQELEDVFYQYDVKSEIYSFGIVLWEIATGDIPFQGCNSEKIRKLVAVKRQQEPLGEDCPSELREIIDECRAHDPSVRPSVDEILKKLSTFSK

SEQ ID NO: 1025035 - protein, 159 aa, Homo sapiens
RYTPPQFSIVMEYCELLTLRELLDRGKDLTLGKRMVLVLGAARGLYRLHHSEAPELQRKNQKLKLPGNSRLPSEALESSSGKSPLEISRFKVKNVKTGSASGCNSEKIRKLVAVKRQQEPLGEDCPSELREIIDECRAHDPSVRPSVDEILKKLSTFSK

SEQ ID NO: 1025036 - protein, 79 aa, Homo sapiens
RYTPPQFSIVMEYCELLTLRELLDRGKDLTLGKRMVLVLGAARGLYRLHHSEAPELHGKIRSSNFLVTQGYQVKIWVPG

SEQ ID NO: 1025037 - protein, 190 aa, Homo sapiens
MEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 1025038 - protein, 331 aa, Homo sapiens
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQDSHCNVTPLPFQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 1025039 - protein, 355 aa, Homo sapiens
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEGRRKPTKAEVQATLLLPGEAFRFLVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQDSHCNVTPLSFQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 1025040 - protein, 190 aa, Homo sapiens
MEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQVQAQLQLDSAVAHAHHHLHPHLAAHAPYMMFPAPPFGLPLATLAADSASAASVVAAAAAAKTTSKDSSIADLRLKAKKHAAALGL

SEQ ID NO: 1025041 - protein, 190 aa, Homo sapiens; identical to SEQ ID NO: 1025040

SEQ ID NO: 1025042 - protein, 141 aa, Homo sapiens
PNGGDERSLGGFARRSNPEEASYEGSGGGGRGHFGSGRNGGGYMNALQPSSRSCSFEGEKITINKDTKVPMPAYSPSQETHTGNIIKYVPASPSPSAVIVSFLRPPQPRFLYSLQNCESIKALFFILPYIRLEAFGHLKEG

SEQ ID NO: 1025043 - protein, 87 aa, Homo sapiens
PNGGDERSLGGFARRSNPEEASYEGSGGGGRGHFGSGRNGGGYMNALQPSSRSCSFEGEKITINKDTKVPMPAYSPSTKKTTALQPR

SEQ ID NO: 1025044 - protein, 158 aa, Homo sapiens
PLPPSTYVEFTVSGTDCVAKEATEAAKCNLLAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 1025045 - protein, 176 aa, Homo sapiens
PLPPSTYVEFTVSGTDCVAKEATEAAKCNLLAEKQYGCCKATLSEKLGGAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 1025046 - protein, 243 aa, Homo sapiens
SWCGASRLVRVHSATMPEETQTQDQPMEEEEVETFAFQAEIAQLMSLIINTFYSNKEIFLRELISNSSDALDKIRYESLTDPSKLDSGKELHINLIPSKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDKTEYLEEREIKEIVKESISQFIGYSITLFVEKGTK

SEQ ID NO: 1025047 - protein, 89 aa, Homo sapiens
GDQIDLSMATVEPETTPTPNPPTTEEEKTESNQEVANPEHYIKHPLQNRWALWFFKNDKSKTWQANLRLISKFDTVEDFWALYNHIQCV

SEQ ID NO: 1025048 - protein, 563 aa, Homo sapiens
MDFGSLETVVANSAFIAARGSFDGSSSQPSRDKKYLAKLKLPPLSKCESLRDSLSLEFESVCLEQPIGKKLFQQFLQSAEKHLPALELWKDIEDYDTADNDLQPQKAQTILAQYLDPQAKLFCSFLDEGIVAKFKEGPVEIQDGLFQPLLQATLAHLGQAPFQEYLGSLYFLRFLQWKWLEAQPMGEDWFLDFRVLGKGGFGEVSACQMKATGKLYACKKLNKKRLKKRKGYQGAMVEKKILMKVHSRFIVSLAYAFETKADLCLVMTIMNGGDIRYHIYNVNEENPGFPEPRALFYTAQIICGLEHLHQRRIVYRDLKPENVLLDNDGNVRISDLGLAVELLDGQSKTKGYAGTPGFMAPELLQGEEYDFSVDYFALGVTLYEMIAARGPFRARGEKVENKELKHRIISEPVKYPDKFSQASKDFCEALLEKDPEKRLGFRDETCDKLRAHPLFKDLNWRQLEAGMLMPPFIPDSKTVYAKDIQDVGAFSTVKGVAFDKTDTEFFQEFATGNCPIPWQEEMIETGIFGELNVWRSDGQMPDDMKGISGGSSSSSKSGMCLVS

SEQ ID NO: 1025049 - protein, 108 aa, Homo sapiens
ELQAKVIDTQQEVKLADIQISTANRTKKHAHLTDTEIMTLVDETNMYEGVGRRFILQSKEAIHSQLLEKQKIAEEKIKELEQKKSYLERSVKEAEDNIREMLMARRAQ

SEQ ID NO: 1025050 - protein, 148 aa, Homo sapiens
MGTVNVIAAKTLSTTDVGPLKPRSPPTYITPDFSFAHSLSVALPPFSGDDGIAKRTGYRSNESSWIFGSCFAINCIYWIAGTGFFPFGVYSVGIAAITAAICQSPEAHPDKDQRWLAAAVAGIFYLLAGLFGSAITGMMAALPVSWSR

SEQ ID NO: 1025051 - protein, 272 aa, Homo sapiens
RGGLTARGRKRTVSASSCQAGGWMRRSSLETWPASGTIILVSLHGRGGLLGKASISTELALALRHAGQTRWESVACGPVLPQYPPHARGRMGRVCALTCDRGMEHRSSSLEPRGAVASLAHVCVASCCENTCDESRECGAGPNVPRADTSMFCCLDVCLGRSCITWWWTCSPGNSPMVHFGRGIEALRPYQPLGALVVTTPQVVSLGDVRREMTFCRKTGLRLMANRGEYEWVHLPTLHGVHQRLLQGRRRGAGPARRGDLLRLQCPWTLSS

SEQ ID NO: 1025052 - protein, 394 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELERTQAKIEDEKKDEEKGRPPKEFLNLWLTVFNELLTCSVIWLQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 1025053 - protein, 381 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELERTQAKIEDEKKDEEKGRPPKEFLNLWLTVFNELLTCSVIWLQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDLK

SEQ ID NO: 1025054 - protein, 320 aa, Homo sapiens
MKLVLPVNTVAQIRKPKILMQEVSIIVATRKYAVLYQPLFDKRFEIINAIYEPTEEECEWKPDEEDEISEELERTQAKIEDEKKDEEKGRPPKEFLNLWLTVFNELLTCSVIWLQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 1025055 - protein, 149 aa, Homo sapiens
MADQLTEEQVTEFKEAFSLFDKDGDGCITTRELGTVMRSLGQNPTEAELRDMMSEIDRDGNGTVDFPEFLGMMARKMKDTDNEEEIREAFRVFDKDGNGFVSAAELRHVMTRLGEKLSDEEVDEMIRAADTDGDGQVNYEEFVRVLVSK

SEQ ID NO: 1025056 - protein, 149 aa, Homo sapiens; identical to SEQ ID NO: 1025055

SEQ ID NO: 1025057 - protein, 325 aa, Homo sapiens
MRLRNQRQGRFFHLPFILQKALHSRQERALKFIEWETAAGGRPGREERKGNSGGRSPAWIAPKLTHHALTAGVIRGPRGSAGSRCKQARGVASARFAGPGLLSKQDRPGQAGQGRLAMMGEDLLLLKLQRLKPGRDSPPAARISTCHPRAGTAAGLRHWEGDPTVASSATHAPTPGMADQLTEEQVTEFKEAFSLFDKDGDGCITTRELGTVMRSLGQNPTEAELRDMMSEIDRDGNGTVDFPEFLGMMARKMKDTDNEEEIREAFRVFDKDGNGFVSAAELRHVMTRLGEKLSDEEVDEMIRAADTDGDGQVNYEEFVRVLVSK

SEQ ID NO: 1025058 - protein, 325 aa, Homo sapiens; identical to SEQ ID NO: 1025057

SEQ ID NO: 1025059 - protein, 149 aa, Homo sapiens; identical to SEQ ID NO: 1025055

SEQ ID NO: 1025060 - protein, 160 aa, Homo sapiens
FNGRVRSLVNLRGSDQDSALAPTICVKQHQRGTSLFQLYECRTATGVQFNRRNIKFQNPHILNNQRIDTGLVEVSNQPLRGFQLIIMQNGVKRDENFCTITMGKRHQLGNIFQAITGIMTGTKTRAADINSIGTVQNSFAWQWAGIGCRALNSFKSMEDV

SEQ ID NO: 1025061 - protein, 288 aa, Homo sapiens
MQIPQAPWPVVWAVLQLGWRPGWFLDSPDRPWNPPTFFPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 1025062 - protein, 348 aa, Homo sapiens
AWHEAEMQLKGKKVTDKFTESVYVLANEPSVALYRLQEHVRRSLPELAQHKADMQRWEEQSQGAIYTVEYACSAVKNLVDSSVYFRSVEGLLKQAISILGPYECHVPRATSPGGSTPALLSLILEETRGPPASCNPVSVPEVVATSLSLCSELTNPARLAASAWHLLVYPLGVSSLGLWDDFGGGMVEWVSAGPECTSTAAQWTMSAHLIPLSLHHSSSLFSMAIGPMLVPEDFHPPKTENGEPTLSSILPSAKKPRFNPEPHSLSVARALAMGKYTHLSTGTYPKPSNLPYRACVDPEGQNFHRTPIPSGFILAHIHNISRYTGLGDLQGVTPADTACPGRHTLHGE

SEQ ID NO: 1025063 - protein, 262 aa, Homo sapiens
AWHEAEMQLKGKKVTDKFTESVYVLANEPSVALYRLQEHVRRSLPELAQHKADMQRWEEQSQGAIYTVEYACSAVKNLVDSSVYFRSVEGLLKQAISILGPYECQCPGPQVAPGTARPHCHSQLQGPSLSCAGNRCFSLIRKLSLSFCPGVWDLLLSCGIYNLSFKFTLKYARSCALLCAWPWAGPKLWVVVEIQNLMANVDPEDRPGGSQGRHTDNSGKHGRQEHVRCAVKNTAGPLLGGGMSYMQTETIRGQTEFHVGQW

SEQ ID NO: 1025064 - protein, 332 aa, Homo sapiens
AWHEAEMQLKGKKVTDKFTESVYVLANEPSVALYRLQEHVRRSLPELAQHKADMQRWEEQSQGAIYTVEYACSAVKNLVDSSVYFRSVEGLLKQAISILGPYECQCPGPQVAPGTARPHCHSQLQGPSLSCAGNRCFSLIRKLSLSFCPGVWDLLLSCGIYNLSFKFTLKYRGPALCCVPGPGLGTGDIAVTETDRLIKGDIRTTQVNMADKSMSDACEEHCGAPPRRWHELHADRDDPGADGVPCGAVVRADALGLGSLGVFEKHREGFCGWSRPAGGDGAREMVWGWDPWECSRSTEKAYHGWSRPAGGDGAREMAGASPCPRTQSQGRL

SEQ ID NO: 1025065 - protein, 167 aa, Homo sapiens
TCAPGKPRRSLSPGWQRGGRTMPGVTVKDVNQQEFVRALAAFLKKSGKLKVPEWVDTVKLAKHKELAPYDENWFYTRAASTARHLYLRGGAGVGSMTKIYGGRQRNGVMPSHFQPRAPRVWPAGSSKALEGLKMVEKDQDGGRKLTPQGQRDLDRIAGQVAAANKKH

SEQ ID NO: 1025066 - protein, 149 aa, Homo sapiens
MPKNKGKGGKNRRRGKNENESEKREWVFKEDGQEYAQVIKMWGNGRWKHMCMMVKRGYAISGGNLRHQGWINTSDIIWVVYGTIRINKADVILTYNCRMKAKKPEGIWTSFQNMLKSMQQDIVVLEMDDEIPELRRIMENDDEEPLMII

SEQ ID NO: 1025067 - protein, 107 aa, Homo sapiens
KLLMGYVKPQIKQVVPEFVNASADAGGQQRHVHGPGPLPQLCAPRLPITCTPQNPDHVLDQDGEFDLDETMDVARHVEELLRRPMDSLDSRLSPPAGLFTSARGSLS

SEQ ID NO: 1025068 - protein, 62 aa, Homo sapiens
MLMTTFDKISLAQRLENKNSMRSREISAYLFKGNNRWKQSVELCKKDSLYKDAMQYASESKD

SEQ ID NO: 1025069 - protein, 229 aa, Homo sapiens
MLSFSMCPGVLQATRTFHTGQPHLVPVPPLPEYGGKVRYGLIPEEFFQFLYPKTGVTGPYVLGTGLILYALSKEIYVISAETFTALSVLGVLVYGIKQYGPFVADFADKLNEQKLAQLEEAKQASIQHIQNAIDTEKSQQALVQKAPLPFDVQRNYIAMGWEVTYRGTTVLEYIGKVKKSPGTIIYSVQNIDAFERTRTPDNWVEKPVVQRFPHGKKGNIAKGLATKAL

SEQ ID NO: 1025070 - protein, 276 aa, Homo sapiens
LVSGHLGSALTDSPIGVTGTLRLLPGLSLTMLSRVVLSAAATAAPSLKNAAFLGPGVLQATRTFHTGQPHLVPVPPLPEYGGKVRYGLIPEEFFQFLYPKTGVTGPYVLGTGLILYALSKEIYVISAETFTALSVLGVLVYGIKQYGPFVADFADKLNEQKLAQLEEAKQASIQHIQNAIDTEKSQQALVQKAPLPFDVQRNYIAMGWEVTYRGTTVLEYIGKVKKSPGTIIYSVQNIDAFERTRTPDNWVEKPVVQRFPHGKKGNIAKGLATKAL

SEQ ID NO: 1025071 - protein, 195 aa, Homo sapiens
SGILDLLPPSSLYPTPPIGACAGAWGGEGAPCSPSRSDHKQLPGTSIVGHLALRPLERCRPDFPCQPGAHSAAQRTVPHRTGALLGSTGASPVPVSLSASPLEGTLWAPPPPRVQLPQSWHPLLHSASVSHFRTSPGVFPGPARPCLTFPLLVCAGLRRTPCPHSTQPGIQTAAPRQPYLPFPVLGHVVATLCDL

SEQ ID NO: 1025072 - protein, 89 aa, Homo sapiens
ANSCMAQQSKVDRVRVTLAYLSSRLACIIPLSCISRIPCSDQRVLQSTTLATILVHDISSPRIEADIMPYLKQGFPSCFVTCATFDITV

SEQ ID NO: 1025073 - protein, 104 aa, Homo sapiens
MRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRT

SEQ ID NO: 1025074 - protein, 149 aa, Homo sapiens
MDYHHAIQQLVSGERVEGQVLGFGHGVPDPGAWPSDWRRGPQEAVAREKLKLEEEKKKKLERFNSTRFNLDNLADLENLVQRSKKRLRHRVPRKEPLVKPQSQAQVEPVGLEMFLKAAAENQEYLIDKYLTDGGDPNAQNKAVVTMWKS

SEQ ID NO: 1025075 - protein, 109 aa, Homo sapiens
MSSSCPVATASVHPDAGAMAKQAFKTMEKTTPHLENEDTSVTNTPFYTNQYPLFIKTGYPLQPSRLSWAERSPCFSHQGLSDRAHACYAMPADSKIGRVQSGRDAGSWH

SEQ ID NO: 1025076 - protein, 74 aa, Homo sapiens
MAKQAFKTMEKTTPHLENEDTSVTNTPFYTNQYPLFIKTGYPLQKKNRKKRGGLWDSPLGAQSRLKGEGLKITG

SEQ ID NO: 1025077 - protein, 137 aa, Homo sapiens
MIVSASTCGAKNLQQFEIMSFDFKQAATVNVKYVDTKGNQIAQGEVTYPNGANVNGTYTTGQLEISNYKFVRMDDGTATGAKSLPATGTLTKAGDNGTVIYVYAEDAPTVTTESKTVNETFIIKALVIKLLLITPLK

SEQ ID NO: 1025078 - protein, 43 aa, Homo sapiens
MKWMFKEDHSLEHRCVESAKIRAKYPDRFQVIVEKVSGSQIVD

SEQ ID NO: 1025079 - protein, 303 aa, Homo sapiens
FLRRHQIETGLRAVVLAKLSSLFVKCLQNPFQSTSGLVAEKMIMVGKSTGPYLPSHRGATQAHRSPSPEWLFLHNTKDKNTVVQGLQRPGQLVNLLKMRQGEEVFQSLSKILDVASEEVLNEVNRRIPERSWPARPTSTEQVDDSHPDMRGLGQQQHGLLHILCSMYAILEQYIGSTGELGSRAFPESISNINETTAKALKSKPTHKLRIASFHRLTVSCGRRDKEQGTRPLAASRATDMGADPRKAATVQSQTRDRVWKHNTKPGAQTGGLPLLHEPEHLARRDWCNQNVFPTYHRGGHQSV

SEQ ID NO: 1025080 - protein, 479 aa, Homo sapiens
MNWSHSCISFCWIYFAASRLRAAETADGKYAQKLFNDLFEDYSNALRPVEDTDKVLNVTLQITLSQIKDMDERNQILTAYLWIRQIWHDAYLTWDRDQYDGLDSIRIPSDLVWRPDIVLYNKADDESSEPVNTNVVLRYDGLITWDAPAITKSSCVVDVTYFPFDNQQCNLTFGSWTYNGNQVDIFNALDSGDLSDFIEDVEWEVHGMPAVKNVISYGCCSEPYPDVTFTLLLKRRSSFYIVNLLIPCVLISFLAPLSFYLPAASGEKVSLGVTILLAMTVFQLMVAEIMPASENVPLIGKYYIATMALITASTALTIMVMNIHFCGAEARPVPHWARVVILKYMSRVLFVYDVGESCLSPHHSRERDHLTKVYSKLPESNLKAARNKDLSRKKDMNKRLKNDLGCQGKNPQEAESYCAQYKVLTRNIEYIAKCLKDHKATSSKGSEWKKVAKVIDRFFMWIFFIMVFVMTILIIARAD

SEQ ID NO: 1025081 - protein, 173 aa, Homo sapiens [sequence omitted]

SEQ ID NO: 1025082 - protein, 119 aa, Homo sapiens
KRLETRKRAPRRKCKLSGKPGIQVSGGKGGRRGKTFAAEETTPPRPLCLDPNSSSNIRDSARLLGPPVSLPCGTLCRESAKSWMAAIVLAETGCLANPSNLDECSLSDSPMRKSAFRST

SEQ ID NO: 1025083 - protein, 268 aa, Homo sapiens
MHEEQQRERTHTKAHNKRKHNTKTREGKQTHTEQRRHQNTEINRNETMTERAKTKTPGDNNNDPPTPPPERGTPTNSSITKMKQEIHHKDYTHRQNTDTYTNQPTNAKTQKQRDRKHNQDKQHRTTKKQNTPKRQDNKQTKATTTTTKQPTTDKRKHLQTQQQTTAQRKRRTKQPTKEQARTNTLPRNPTHTRRRQPYAKANTAPATRRATKANTEDERREETEGDETNIATQTQRKYNQQDKGPNAHRRQTKNSAAKTKHARSNRHQ

SEQ ID NO: 1025084 - protein, 113 aa, Homo sapiens
LSWKQSSGRFTNSEAWSTASPLGNLSKKLWELTGEVQFPPAPEEPSVSVARQESIFNVGALIKISTSSLFPDGMELQGWGTSQVNAQRCPELPLRLVWPIYLLTEHAKDDAQK

SEQ ID NO: 1025085 - protein, 188 aa, Homo sapiens
MGKEAADLLLLLLPVASSGCQERGRTFVWALPRAGNFTWYLKVSFGIRPETLGFSRLTTPFYRKHLEDCFRVSPGSLCNHLLWKCRTLCDILYPFFPGLVAMEGLVCCESTLDAVSLMLAREAEDVRGRGRLLGLSSFLCIILGLAWTAPASESCGPHPLAAEPSTVILGAIFPCRTGSLSPAPTFGL

SEQ ID NO: 1025086 - protein, 247 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELRNPF

SEQ ID NO: 1025087 - protein, 171 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEVSHSVTQDWLQWHDHGSLQPPPPRLK

SEQ ID NO: 1025088 - protein, 252 aa, Homo sapiens; identical to SEQ ID NO: 897948

SEQ ID NO: 1025089 - protein, 171 aa, Homo sapiens; identical to SEQ ID NO: 1025087

SEQ ID NO: 1025090 - protein, 208 aa, Homo sapiens [sequence omitted]

SEQ ID NO: 1025091 - protein, 247 aa, Homo sapiens; identical to SEQ ID NO: 1025086

SEQ ID NO: 1025092 - protein, 255 aa, Homo sapiens
PRPAPPRHALAPRHQPGIRQRPGAVARRPHIAAPPGGDKDRSSPRRFWEPVKWFTCKERIWFHPPEMTPQERCICTPRLPIKKIPPEVPFASVGDGETVEFDVVEGEKGAEASQMLPGPGGVPSSRPVNMPARPVTLIDATHDRMGPPCHYQQINQSCESGEKNERFGRVLPKARPHNAGPTAGEGSHPYYMRRPYGRRPQYSNPPVQGEVMEGADNQGAGEQGRPVRQNMYRGYRPRFRRGPPRQRQPREDGNE

SEQ ID NO: 1025093 - protein, 127 aa, Homo sapiens
MMHLYRKLNRRYPRSYGSSTQLPSQINQSCESGEKNERFGMSAPEGRAPQRRPYRRRGFPPYYMRRPYGRRPQYSNPPVQGEVMEGADNQGAGEQGRPVRQNMYRGYRPRFRRGPPRQRQPREDGNE

SEQ ID NO: 1025094 - protein, 144 aa, Homo sapiens
VTGPGECSSPTHVNMQRTGTMYRGDPRCTGAHIQLTSIMIQKYMSSWGIRTRSRTRECLRECRPNDAGPSGGRRGSHPYYMRRPYGRRPQYSNPPVQGEVMEGADNQGAGEQGRPVRQNMYRGYRPRFRRGPPRQRQPREDGNE

SEQ ID NO: 1025095 - protein, 93 aa, Homo sapiens
SSGIKRIVAIMAGEKPGGLGAPAGIGSRLGCERFSRSREILQAITMSTDTGVSLPSYEEDQGSKLIRKAKEAPFVPVGIAGFAAMCVHMDYIN

SEQ ID NO: 1025096 - protein, 122 aa, Homo sapiens
SSGIKRIVAIMAGEKPGGLGAPAGIGSRLGCERFSRSRNSGFCSNVCAYGLYKLKSRGNTKMSIHLIHMRVAAQGFVVGAMTVWYGLFHVSGILGQNLSLRRRDAVCGLCWRSCALVEMSYY

SEQ ID NO: 1025097 - protein, 93 aa, Homo sapiens
MSTDTGVSLPSYEEDQGSKLIRKAKEAPFVPVGIAGFAAIVAYGLYKLKSRGNTKMSIHLIHMRVAAQGFVVGAMTVGMGYSMYREFWAKPEP

SEQ ID NO: 1025098 - protein, 475 aa, Homo sapiens
FFRTYPDQPTLSLSHLCTASLLSLIYPHICPHFGVPTVTPLFPAFWPRVYVPLPSHRGSCVIPLNRFLWLHRVALAVASRHPRPRPDCPSPTCRLVVSFSLAVSLYRTPRVSLLSLLRRLCVGFALFVSSLRLFSSLGSVLSLYLVVVPRVSSMGLRCMVSEVVLLLPVVIRSQHCVAHRMSCLCCVSPSLFPGHLVCHPVCRVQHCEPRLVRYHLVVYIRSVVQNQLLMFESLLVQWLCRLHELSALWFVCRPGSLMPTFKGWQLLKSGSRKPVHLCSALIPGQKDPGLAAPPHGIEHPEPARAAAAGQGGQGDSVGQEQKPAHRSLPAPGSISTPGPAWARAAGAQHRTSVTGAGRGRTSGRSPDEGRGLGRGGVVGRSPELAPDEPELVNFLSVLEEAEPGLQIPKAGEVWDEGGAYGSGAEALGPAEEGRDGPCWAPSLPAPRPQFGGHAPACSGHRGKPLNPLAPGTHVR

SEQ ID NO: 1025099 - protein, 153 aa, Homo sapiens
GREPRRGLRGAWRLLGHAGPSGTGRLRVGGLRSWGLGGDGPAGRRRRQDRVGLRARRRPSRLLAPLAWCPAPGREAAGLDRAGLPGGARALAAGRPLLSAMAGLHPWVIFSGPLWPLLTPREQTTRTTQEQIKSRPQPARERASILFAPRVAV

SEQ ID NO: 1025100 - protein, 153 aa, Homo sapiens; identical to SEQ ID NO: 1025099

SEQ ID NO: 1025101 - protein, 128 aa, Homo sapiens
GREPRRGLRGAWRLLGHAGPSGTGRLRVGGLRSWGWEGTVLPGGGGGRTGWGCGPGAAPPGSWLPSPGAPRLLSAMAGLHPWVIFSGPLWPLLTPREQTTRTTQEQIKSRPQPARERASILFAPRVAV

SEQ ID NO: 1025102 - protein, 147 aa, Homo sapiens
MREPCAPSALPLTRPPTMPLSLEESAGHWTLHLLTRTTIPQHFSDPVMARILPTESWRCAWELHSDSLTSAWRLRAPGAFSHSDLSTTASTWHRTILTRFLQTEAASPQVQLWRGGGSDCFGPKWPQVAGRSCGWSLGRSHTCSTYW

SEQ ID NO: 1025103 - protein, 146 aa, Homo sapiens
MREPCAPSALPLTRPPTMPLSLEELQALDLHLLTRTTIPQHFSDPVMARILPTESWRCAWELHSDSLTSAWRLRAPGAFSHSDLSTTASTWHRTILTRFLQTEAASPQVQLWRGGGSDCFGPKWPQVAGRSCGWSLGRSHTCSTYW

SEQ ID NO: 1025104 - protein, 217 aa, Homo sapiens
MPTPHEAEKQITGPEEADRPPSMSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPTYRALLLQGPSQSSSEA

SEQ ID NO: 1025105 - protein, 195 aa, Homo sapiens
MSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPTYRALLLQGPSQSSSEA

SEQ ID NO: 1025106 - protein, 143 aa, Homo sapiens
MPTPHEAEKQITGPEEADRPPSMSSHDTASPAAPSRNPCCLCWCCCCSCSWNQERRRAWQASRESKLQPLPSCEVCATPSPEEVQSWAQSFDKLMHSPAGRSVFRAFLRTEYTRDTSFRWRREFRRRDTLCETRDLLRRLRFI

SEQ ID NO: 1025107 - protein, 217 aa, Homo sapiens; identical to SEQ ID NO: 1025104

SEQ ID NO: 1025108 - protein, 286 aa, Homo sapiens
MPTPHEAEKQITGPEEADRPPSMSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPLRPTLGSLQVLVSAGLSGHMPGRLGSPPAETVLDPVGSAVSPGSAHPWPSRNSRCRAGLQVQGGPEAPSSARSWLAQCSWLGALAW

SEQ ID NO: 1025109 - protein, 217 aa, Homo sapiens; identical to SEQ ID NO: 1025104

SEQ ID NO: 1025110 - protein, 158 aa, Homo sapiens
MAEQATKSVLFVCLGNICRSPIAEAVFRKLVTDQNISENWRVDSAATSGYEIGNPPDYRGQSCMKRHGIPMSHVARQITKEDFATFDYILCMDESNLRDLNRKSNQVKTCKAKIELLGSYDPQKQLIIEDPYYGNDSDFETVYQQCVRCCRAFLEKAH

SEQ ID NO: 1025111 - protein, 158 aa, Homo sapiens
MAEQATKSVLFVCLGNICRSPIAEAVFRKLVTDQNISENWVIDSGAVSDWNVGRSPDPRAVSCLRNHGIHTAHKARQITKEDFATFDYILCMDESNLRDLNRKSNQVKTCKAKIELLGSYDPQKQLIIEDPYYGNDSDFETVYQQCVRCCRAFLEKAH

SEQ ID NO: 1025112 - protein, 180 aa, Homo sapiens [sequence omitted]

SEQ ID NO: 1025113 - protein, 403 aa, Homo sapiens
APGASCSALTRSAAAGSPAATLSGAPPADHHGRGPLLGAAVPGGRARAAGGDAGADPGWGAPELPRLRPGSRRGGVARGRTMASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYLSEKRFTFVLAVVMGVFVLCWFPFFFSYSLYGICREACQVPGPLFKFFFWIGYCNSSLNPVIYTVFNQDFRRSFKHILFRRRRRGFRQ

SEQ ID NO: 1025114 - protein, 459 aa, Homo sapiens
APGASCSALTRSAAAGSPAATLSGAPPADHHGRGPLLGAAVPGGRARAAGGDAGADPGWGAPELPRLRPGSRRGGVARGRTMASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRAGAVAAGRAAASGRGGGRGRCGRAGGGAGGGSVGGADRLQGVGRREGETPLPSPLSKGLLLGLPAWIQLWEPCRGVAVRSGF

SEQ ID NO: 1025115 - protein, 461 aa, Homo sapiens
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKRRTRTLSEKRAPVGPDGASPTTENGLGAAAGEARTGTARPRPPTWSRTRAAQRPRGGAPGPLRRGGRRRAGAEGGAGGADGQGAGPGAAQSGALTASRSPGPGGRLSRASSRSVEFFLSRRRRARSSVCRRKVAQAREKRFTFVLAVVMGVFVLCWFPFFFIYSLYGICREACQVPGPLFKFFFWIGYCNSSLNPVIYTVFNQDFRPSFKHILFRRRRRGFRQ

SEQ ID NO: 1025116 - protein, 461 aa, Homo sapiens; identical to SEQ ID NO: 1025115

SEQ ID NO: 1025117 - protein, 230 aa, Homo sapiens
PPGTRPAERRNICPQAKLANPKGVDEHPCSTRVCPQAQAPGADPGDKAAGTTRPEPLGEMVRNEQLAQPDPLVASHPDSMLFPCGDLPGLLQRKNVHTVIISLLDADDLFLYVLNRGQQLDYPRSHTHLSALLLPWLPLALRSGGHRSMLAEDVRNSESPQVLKNGLGQTTVRAQRKGGPSGRVQARHLCFKLGLAMPRGSYGHWLSKCHEVGSVVALSPPNTVPWWRKH

SEQ ID NO: 1025118 - protein, 294 aa, Homo sapiens
SGVIRPGFQRACVAAACTVAARCPGRGVGDRSQSGASCRPIWGPKVGGPTEMLRGMYLTRQREPAEATHDEGSQGHEEQAGDLQTCGGESLEALLRAMQTDMIEGHFKPSSEDSPHVVAESLENVLVYKYGLAGVPSPSFGLSSVSENLEFWLACEDFKKVKSQSKMASKAKKIFAEVHRDPGMQGGQTWTSYTREHSKDNLQSVTRGWFDLETEAHLRAQWQEDSYPRFLRSDLYLDLINQKKMSPPDKGPPGGRCSEFTPGRARGPLAILLPAPVTEGQAKPIRSGVSRQTE

SEQ ID NO: 1025119 - protein, 255 aa, Homo sapiens
MFHCGSRQCGLQADAADPHVPSREGCGADGQEHHDAQGHPRAPGKQPSSGETAAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQNGYPTVASSTPFYHQRVQTSPGLVLLRRITPSHLLNKVKPSVGEPSAFVAAAPVACCTKLLLLCEAQAKVEATEESESRNEHYGHSVLLD

SEQ ID NO: 1025120 - protein, 274 aa, Homo sapiens
MSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQNGYPTVASSTPFYHQRVQTSPGLVLLRRITPSHLLNKVKPSVGEPSAFVAAAPVACCTKLLLLCEAQAKVNATEESESRNEHYGHSVLLD

SEQ ID NO: 1025121 - protein, 319 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQNGYPTVASSTPFYHQRVQTSPGLVLLRRITPSHLLNKVKPSVGEPSCLCGCCPCGLLHKAAPVAVKPKLRLNATEESESRNEHYGHSVLLD

SEQ ID NO: 1025122 - protein, 210 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 1025123 - protein, 252 aa, Homo sapiens
DCLRRAPGARCPGRATMRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQASRGRYIRNLCPPMPAWILQQYYNLTEAA

SEQ ID NO: 1025124 - protein, 213 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGRRRRARLRFMKQPQGEGISGTFVPQCLHGYYSNTTTSQKLLNPWILKT

SEQ ID NO: 1025125 - protein, 176 aa, Homo sapiens
MVEWLPSEAGVSLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 1025126 - protein, 226 aa, Homo sapiens
DCLRRAPGARCPGRATMRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 1025127 - protein, 92 aa, Homo sapiens
DCLRRAPGARCPGRATMRPRLWLLLAAQLTVLHGNSVLQQTPAYIKVQTNKMVMLSCEAKISLSNMRIYWLRQRQAPSSDSHHEFLSLNWDL

SEQ ID NO: 1025128 - protein, 213 aa, Homo sapiens; identical to SEQ ID NO: 1025124

SEQ ID NO: 1025129 - protein, 210 aa, Homo sapiens; identical to SEQ ID NO: 1025122

SEQ ID NO: 1025130 - protein, 221 aa, Homo sapiens
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQLRLHPLEKCSRMDY

SEQ ID NO: 1025131 - protein, 184 aa, Homo sapiens
DGGVRASSVVVNFSDAADGGRRKVLAASVTELQWATQPGGGGTQVVGTFTPAVQKSVEDAALKQNLTTLHNRVNELGFSSRSLQQQGSDRIVVELPGVQDTAKAKDIIGRTATLEARLADPINTHPNPNDPVPPGEELFTQGIQAPVLLKKDVIFTGDRIIDASAGFDEHQRPSVNIRLEPRRP

SEQ ID NO: 1025132 - protein, 224 aa, Homo sapiens
MATLKEKLIAPVAEEEATVPNNKITVVGVGQVGMACAISILGKSLADELALVDVLEDKLKGEMMDLQHGSLFLQTPYHIVAALHTHLLPVTAQFLTTCCCVHLQAAPLQPHAQGARRSGLKIMAGRATLSTAPLTHSTLLPSDSLNATAPESALIHFAASSNPTLAHFPTVLLYPCEHLTLRLTPTPPDAALWPPGPPHSWHPCLHSSLTLYWADPTLGLPSHA

SEQ ID NO: 1025133 - protein, 137 aa, Homo sapiens
MGAYFFRHLKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWIWGNMATQVWLCGVV

SEQ ID NO: 1025134 - protein, 137 aa, Homo sapiens; identical to SEQ ID NO: 1025133

SEQ ID NO: 1025135 - protein, 137 aa, Homo sapiens; identical to SEQ ID NO: 1025133

SEQ ID NO: 1025136 - protein, 144 aa, Homo sapiens
SSSGSQTPESENSRDFHATESQTVLNVSKGEAKPTRADAMVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVGLSRANS

SEQ ID NO: 1025137 - protein, 165 aa, Homo sapiens
RASGRIELAAERLRADDGRKAQDLGAHQREAARRLRVPLVPADADADPPETRIPHPEAGVARREIELLRIARTVRNMCLAVDAEHASVRVRHGDRVVRGIARALEEADRQHDAELAGQRREPGDLRVAFERLREFEMAHVLVEAEVRHREQLRAQHEMSPLRSGR

SEQ ID NO: 1025138 - protein, 153 aa, Homo sapiens
CPIPLIPKWLLAGPSWCPGHESRANRPQAGAALLAQLSILANISVQVALYIAFLFSEAFADLTWASFPRFPFRFLSTSRTQLPQASPCHLGPGLHTWESDRGSSLNSPGSDALNYHPRTHTTPALGGDGPGLLGVPPGEPQLEAGARRGTLGR

SEQ ID NO: 1025139 - protein, 140 aa, Homo sapiens
KNSFPRRRAAALAACAAMAKIKARDLRGKKKEELLKQLDDLKVELSQLRVAKVTGGAASKLSKIRVVRKSIARVLTVINQTQKENLRKFYKGKKYKPLDLRPKKTRAIARRLNKHEENLKTKKQQRKERLYPLRKYAVKA

SEQ ID NO: 1025140 - protein, 135 aa, Homo sapiens
KNSFPRRRAAALAACAAMAKIKARDLRGKKKEELLKQLDDLKVELSQLRVAKVTGGAASKLSKIRVVRKSIARVLTVINQTQKENLRKFYKGKKYKPLDLRPKKTRAIARRLNKHERPEPRRSTEERFPLPESRS

SEQ ID NO: 1025141 - protein, 82 aa, Homo sapiens
MAKIKARDLRGKKKEELLKQLDDLKVELSQLRVAKVTGGAASKLSKIRVVRKSIARVLTVINQTQRGNLRGFYQGAGGVKPL

SEQ ID NO: 1025142 - protein, 140 aa, Homo sapiens; identical to SEQ ID NO: 1025139

SEQ ID NO: 1025143 - protein, 213 aa, Homo sapiens
MAKIKARDLRGKKKEELLKQLDDLKVELSQLRVAKVTGGAASKLSKIRVVRKSIARVLTVINQTHLASGNSTEVMTSMLPDPLPTNDTRHAPSPYHARPEPDDHHPHRNEPPLPLPHPAQSLPPRTVPVPLFSPPPPLPLLISLLSRSPHSTPATLFSTPYLPLLSSLLPCPTLTSRPCPCPPPLATPSPHPSACPYTSPFLHLLRPPSPPPP

SEQ ID NO: 1025144 - protein, 211 aa, Homo sapiens
SYHIGSGYVFAPATSANDSEISSDALTDDSMSMTNSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAA

SEQ ID NO: 1025145 - protein, 137 aa, Homo sapiens
MTTCLRIECKDESYCSHNSTVSDCQVGNTTDFCSVSTATPVPTANSTAKPTVQPSPSTTSKTVTTSGTTNNTVTPTSQPVRKSTSDAASFIGGIVLVLGVQAVIFFLNKLLHIQSTTLTTLLKTDPLNQYRTGSCTV

SEQ ID NO: 1025146 - protein, 717 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPAPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1025147 - protein, 695 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGIPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPAPPGPKGEAGVDGQVGPPGQPGDKGERGAAGEQGPDGPKGSKGEPGKGEMVDYNGNINEALQEIRTLALMGPPGLPGQIGPPGAPGMPGQKGEIGLLGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1025148 - protein, 824 aa, Homo sapiens
MSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIGRTDEAVECTEDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 1025149 - protein, 824 aa, Homo sapiens; identical to SEQ ID NO: 1025148

SEQ ID NO: 1025150 - protein, 313 aa, Homo sapiens [sequence omitted]

SEQ ID NO: 1025151 - protein, 764 aa, Homo sapiens
MTEIAGGSLTRCKPDDSCCLIGAGSGASSSEGRAALPDLFFRPCLRGSEASGRCPGAEARDGAGGSPGSPGSPARAMSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIGRTDEAVECTEDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKVTTFSVYSY

SEQ ID NO: 1025152 - protein, 353 aa, Homo sapiens
SSLLLGIKRSSLSLLSRWDYRCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 1025153 - protein, 813 aa, Homo sapiens
MSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 1025154 - protein, 461 aa, Homo sapiens [sequence omitted]

SEQ ID NO: 1025155 - protein, 123 aa, Homo sapiens
LVPTVVVTERSPVTGGAQLVLVLGDLHIPHRCNSLPAKFKKLLVPGKIQHILCTGNLCTKESYDYLKTLAGDVHIVRGDFDENLNYPEQKVVTGGQFKIGLIHGQQVIPWGDTGQLSPVAEAI

SEQ ID NO: 1025156 - protein, 65 aa, Homo sapiens
KSGGMPRRHPRNTLKSPKQAEESQMNPDDISTVVIVKLTVIEKERKKFAIAVEISGLLLPSIVNI

SEQ ID NO: 1025157 - protein, 399 aa, Homo sapiens
ADSVLLGQPTSLAGVRKMATNFLSHENDSTFDKFKYEQTQKGDFYVAMMKRCLCPGASRPSDERQSSVILRASLPQMLIENIQKSLVWKLRPRGLQRQPAETTVSSSSGWPVWKWRTTMSAVCVVQELQQAIFKAGRARLNVLEKSSPGHRVTSPQTQHVSPMRQVEPQPRSSTPAEDDEDDDIDLFGSDNEEEDNEAAQLAGGAATAGTADDRGHEDSALVSKSSILLDVKPWDDAEDIGQWRPVVRSIQGLDRGLAWGGYQSLVARWGLPESEKATRIHSVLVDGRHTVGDHTFALDVKYDIPKVRETHVRSVQPCARFDNAAIRKSPADVFGTFTHGGLSGPGHAITKMDNGHNERNNTKNTTQSCRRNDIMREGPERQAEIDECSDHQRVTEHRR

SEQ ID NO: 1025158 - protein, 109 aa, Homo sapiens
AENRLNPGGGACSEPRSRHCTPAWATERDSISEKKELEGGTLRHPVHKAVKGVSGLAFLPRSDLRSPCSILCPLTGPLLDCQVPVWFGGEDFGVGRVSSWLSGILSKRK

SEQ ID NO: 1025159 - protein, 459 aa, Homo sapiens
FITTGQEGHVLISMRECLSIHIGQAGIQIGDACWELYCLEHGIQPNGVVLDTQQDQLENAKMEHTNASFDTFFCETRAGKHVPRALFVDLEPTVIDGIRTGQHRSLFHPEQLLSGKEDAANNYARGRYSVGSEVIDLVLERTRKLAEQCGGLQGFLIFRSFGGGTGSGFTSLLMERLTGEYSRKTKLEFSVYPAPRISTAVVEPYNSVLTTHSTTEHTDCTFMVDNEAVYDICHRKLGVECPSHASINRLVVQVVSSITASLRFEGPLNVDLIEFQTNLVPYPRIHFPMTAFAPIVSADKAYHEQFSVSDITTACFESSNQLVKCDPRLGKYMACCLLYRGDVVPKEVNAAIAATKSRHSVQFVDWCPTGFKVGINNRPPTVMPGGDLAKVHRSICMLSNTTAIVEAWARLDHKFDLMYAKRAFLHWYLREGMEEAEFLEAREDLAALERDYEEVAQSF

SEQ ID NO: 1025160 - protein, 296 aa, Homo sapiens
GCCVGVGGRFRWRTAVPWRAGCGAAAAVAQQAGQRDYDLLVCLAGGSGGLACAKDVPAQLGTEWCPVVDYVGTFSPRHPVWVPLAGNLAVQLLVLAIPKKLMHQAGTAGRPDPRCPQLWLGGGQPCRYDWRKMAEAVQNHVKSLNWGHVSSFRTEKSSTLTSKPALLTSTRFAALPKVGTEILLSADHIIIATGGRPRYPTHIEGALEYGLTSDDIFWLKESPGKNVGGRGQLCGLGVCWLPHRDWGWDTTIMMRPFRGFRPANVPPWFIGGTWASSWAPGFLEGVALSGGFREAS

SEQ ID NO: 1025161 - protein, 170 aa, Homo sapiens
MALLTALDDTLPEEAQGPGRRMILLSTPSQSDALRACFERNLYPGIATKEELAQGIDIPEPRVQIWFQNERSCQLRQHRRQSRPWPGRRDPQKGRRKRTAITGSQTALLLRAFEKDRFPGIAAREELARETGLPESRIQIWFQNRRARHRGQSGRAPTQASIRCNAAPIG

SEQ ID NO: 1025162 - protein, 225 aa, Homo sapiens
GGPGMLRRPLAGLAAGRSVGRAPPDGMSGPRPVVLSGPSGAGKSTLLKRLLQEHSGIFGFSVSHTTRNPRPGEENGKDYYFVTREVMQRDIAAGDLHRACRVLGEPVWHEQGGGAGRAGMNRICVLDVDLARVCGNIQATDLRPIYISVQSAFTATCWEQRLRQRNTETEESLVKRLAAAQADMESSKEPGLFDVVIINDSLDQAYAELKEALSEEIKKAQRTGA

SEQ ID NO: 1025163 - protein, 246 aa, Homo sapiens
EDPVQESAGVSFSLHGQTRDDSRASVVKGWGLHVLCGSWKSPISSGGMSGPRPVVLSGPSGAGKSTLLKRLLQEHSGIFGFSVSHTTRNPRPGEENGKDYYFVTREVMQRDIAAGDLHRACRVLGEPVWHEQGGGAGRAGMNRICVLDVDLARVCGTSKATDLRPIYISVQSAFTATCWEQRLRQRNTETEESLVKRLAAAQADMESSKEPGLFDVVIINDSLDQAYAELKEALSEEIKKAQRTGA

SEQ ID NO: 1025164 - protein, 176 aa, Homo sapiens
MNDTQMKLTGLKEILTYLDNPIEQAQSRDVWLRYMTHTGNKNSHKQRCTPELQTDKVLTRAAKTIPWNEHEQNYHKDRQTAHGSQECTTLRTRERPEQPQPTYAKTGTQGRQNGRHNDTDTLDSNYTSDRPELRAQQTDDMREMGTLDKNCTKQQQEDRADPLKSRGTATQRNNEQ

SEQ ID NO: 1025165 - protein, 121 aa, Homo sapiens
SGSRASAAAEQRREPGGLPAGVKKKMTLQWAAVATFLYAEIGLILIFCLPYIPPQRWQKIFSFNVWGKIATSLEQGFPYHYHPIDCSISRVSRRVVTLYYSHWQKETVKQRCNLKGQAEKY

SEQ ID NO: 1025166 - protein, 171 aa, Homo sapiens
MTLCRMSWMLLSCLMFLSWVEGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1025167 - protein, 135 aa, Homo sapiens
MLATRVFSLVGKRAISTSVCVRAHESVVKSEDFSLPAYMDRRDHPLPEVAPCQAPVCQPEGTEGRRRRPPGAASPWMRNVELYRIKFKESFAEMKRGSNEWKTVVGGAMFFTLFTGARYIMQADKLLCLRPLRKV

SEQ ID NO: 1025168 - protein, 183 aa, Homo sapiens
MLATRVFSLVGKRAISTSVCVRAHESVVKSEDFSLPAYMDRRDHPLPEVAPCQAPVCQPEGTEGRRRRPPGAASPWMRNVELCGIDRDPSGRAQLRFSENAMSVTEAIVLIFVEPYLSRRALCRQEGLTLLGYSEVTVAQGPELYVRHRVTELCSADRIFCWAPFSVLSGGSLSAISAGIRHS

SEQ ID NO: 1025169 - protein, 130 aa, Homo sapiens
HEGIPCAKLGAPESLTTMPPPRLLFFLLFLTPMEVRPEEPLVVKVEEGDNAVLQCLKGTSDGPTQQLTWSRESPLKPFLKLSLAGQSMWRAAGRAGLGQGQEERREATMDRRGPRPQWSWREGLQALGPT

SEQ ID NO: 1025170 - protein, 269 aa, Homo sapiens
DPEPEVCNQEQNFAPELKASALDLDSAPGFKAGFLDPESIRRAQNILFPCPAARTLSLDRPISSDPSLTMPLSPGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 1025171 - protein, 405 aa, Homo sapiens
MSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 1025172 - protein, 250 aa, Homo sapiens
DPEPEVCNQEQNFAPELKASALDLDSAPGFKAGFLDPESIRRAQNILFPCPAARTLSLDRPISSDPSLTMPLSPGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMGSQSYEDMRGILYAAPQLRSIRGQPGPNHEEDADSYENMDNPDGPDPAWGGGGRMGTWSTR

SEQ ID NO: 1025173 - protein, 556 aa, Homo sapiens [sequence omitted]

SEQ ID NO: 1025174 - protein, 556 aa, Homo sapiens [sequence omitted]

SEQ ID NO: 1025175 - protein, 573 aa, Homo sapiens
HEGIPCAKLGAPESLTTMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 1025176 - protein, 113 aa, Homo sapiens
TPLYQTSKEELVEVGLIYSSYDLGGERLLSSNQKLYPGIQLVCEPLYPQGSPGYSHGLHCKPLCSLQNSGDEEELIFPSDVDPFPFHAASLTLDFGALKVSWTRHWDNSSMAC

SEQ ID NO: 1025177 - protein, 100 aa, Homo sapiens
ENGQQEGGPRGKWAATKQAHRGSSTVFSMFDQAQIQEFKEAFRVYIAQIRDVTSSAETSEGHLLHREMSVYQRAARVISSKATTSTSTMFGEELETPENH

SEQ ID NO: 1025178 - protein, 73 aa, Homo sapiens
ENGQQEGGPRGKWAATKQAHRGSSTVFSMFDQAQIQEFKEAFRVYIAQIRDVTSSAGRPLGGPPPAGKVVHRE

SEQ ID NO: 1025179 - protein, 363 aa, Homo sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 1025180 - protein, 266 aa, Homo sapiens
MQPVSRWHKQEQLHFFPETHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGITVWDWPQQSPKEGPCVCACLSDRP

SEQ ID NO: 1025181 - protein, 356 aa, Homo sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNMLWSVPTLTSCRMSPSPLTESPIPSAQLPTPYWTSWMECSSAAVAFKDLTSTLQLGPSGSWGMSSFDSFTQSLTVGPRLAGAARLARAPVLRGL

SEQ ID NO: 1025182 - protein, 396 aa, Homo sapiens
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 1025183 - protein, 396 aa, Homo sapiens; identical to SEQ ID NO: 1025182

SEQ ID NO: 1025184 - protein, 193 aa, Homo sapiens
RNTFLRPGALGQHCVLRLVSYLRLPSICVQRAPAPAQPVTLQGHTHRVPTQDSRHPPCARPVTAPRPSSPTGTDWGTAWPSLHQGPLLMNSGALRKGQPPTLSPSLPLLSSFLKTASPKHNALAMKESEPWVRMDRLRSASTSGKPNDANWARDSPHTHTMPVGLLKEPPIAFLAPDKKRKLFWGYTGPTPGN

SEQ ID NO: 1025185 - protein, 614 aa, Homo sapiens [sequence omitted]

SEQ ID NO: 1025186 - protein, 129 aa, Homo sapiens
GRAGHHGPGRARPAVATSAFPAQEPRVFLRSALPAGRLSPSTTHLHLVTADNPAANWLHARSTRKKRCPYTKHQTLELEKEFLFNMYLTRDRRYEVARLLNLTERQVKIWFQNRRMKMKKINKDRAKDE

SEQ ID NO: 1025187 - protein, 129 aa, Homo sapiens; identical to SEQ ID NO: 1025186

SEQ ID NO: 1025188 - protein, 42 aa, Homo sapiens
MGESLELPRDLLNGFDQNADNDVVNEIQAEVVSDGDEELVGN

SEQ ID NO: 1025189 - protein, 289 aa, Homo sapiens
LDARCESVGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRACVPCECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 1025190 - protein, 224 aa, Homo sapiens
LDARCESVGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRACVPCECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSEI

SEQ ID NO: 1025191 - protein, 94 aa, Homo sapiens
DFDDRVSDEEKVRIAAKFITHAPPGEFNEVFNDVRYYLIMTISSGKGQHMHLPSINMDQFTPVKIEGYEDQVLITEHGDLCNSRFLPFQTKFSF

SEQ ID NO: 1025192 - protein, 281 aa, Homo sapiens
SFCTARSGSAAALRMRPVRLMKVFVTRRIPAEGRVALARAADCEVEQWDSDEPIPAKELERGVAGAHGLSASSPKHSGQEDPVMLQGGHSLQSSSASMLWGSYDQLGMDVQSTNAWDPELVHPRCPDRYHRELASLPATYPPAAVAGGHRGSEEWWLTSWKPSGCVAMDSTQSTVGIIGLGARPGIARRLKPFGVHEISCTQGRQLRPEEAGTNSRAELGLPPEAWCPNLFNDEALVFNLNRGSAQDSSEYEDRCVLTSDGHQTSTCPDCKVLAARSAPLV

SEQ ID NO: 1025193 - protein, 220 aa, Homo sapiens
MPNIGYGSNKKTKHMLPSGFRKFLVHNVKELEVLLMCNKSYCAEIAHNVSSKNRKAIVERAAQLAIRVTNPNARLRSEENESAAHVHVFCLNKCKNCHSGIFLQKKKGNLNRAGDKERHLHHTKKRQQLGTKRTATSSEGTAHSDCPPKHGFPKQDVRPPTRSSPQVKSHTKHSDSTAEHITTERRGRNSPGLEGHPSEEQNTIHTSGEKATGERVTQQD

SEQ ID NO: 1025194 - protein, 141 aa, Homo sapiens
PSLFLGAAYGGGSHLLLGIMAALRPLVKPKIVKKSKIKRNWRKPRGIDNRVRRRFKGQILMPNIGYGSNKKTKHMLPSGFRKFLVHNVKELEVLLMCNKSYCAEIAHNVSSKNRKAIVERAAQLAIRVTNPNARLRSEENE

SEQ ID NO: 1025195 - protein, 154 aa, Homo sapiens
PSLFLGAAYGGGSHLLLGIMAALRPLVKPKIVKKRTKKFIRHQSDRYVKIKRNWRKPRGIDNRVRRRFKGQILMPNIGYGSNKKTKHMLPSGFRKFLVHNVKELEVLLMCNKSYCAEIAHNVSSKNRKAIVERAAQLAIRVTNPNARLRSEENE

SEQ ID NO: 1025196 - protein, 87 aa, Homo sapiens
RSNYPGVPLVVPSRIRHCIGLADINVTLHETTYNSIMKCDIDIRKTLYASRFHTNEAIVSCFMDASRFHTNEGGLEECLRTAEALIT

SEQ ID NO: 1025197 - protein, 71 aa, Homo sapiens
RSNYPGVPLVVPSRIRHCIGLADINVTLHETTYNSIMKCDIDIRKTLYANNVLSGGTTMYPGFSDRYCRGN

SEQ ID NO: 1025198 - protein, 86 aa, Homo sapiens
LLLAGYDDFNCNVWDALKADRAGVLAGHDNRVTALGVTDDGMAVATGSWDSFLKIWTNASSMWMPWRLETIPTWTRSHESISIQPY

SEQ ID NO: 1025199 - protein, 71 aa, Homo sapiens
GPPVTMVSMSFKRNVTGSTAPGLRLLPCPHRDVHPGDLVHGSKPIDGILTVEDDGCMFLVCICFHLCDKMI

SEQ ID NO: 1025200 - protein, 101 aa, Homo sapiens
PPENRRHNPPRLVMYRCRIRGSQLVDIKMPLLSIYFQTLRSFLTSVKRLFVFLVSLLHLNSFEEQSRLSKSKVPLFAFNWGVGREKGYLPHSFLFNSTFFK

SEQ ID NO: 1025201 - protein, 173 aa, Homo sapiens
HRAGGNTGLNPCQPAGGRGAPLRIRETQRPSRRLQVATLPGPLWLRLRALALARERCNGLSLLGVAGEGLHLPQDGQVHQHLQQTEKLKEHLEAVAGEGLHLPQDGQVHQDLEQDGELKEHLEAVAVLKVSPLVLTSTILILVACCAWVGKRFCEGLLERSRLFQGKFKFRSR

SEQ ID NO: 1025202 - protein, 406 aa, Homo sapiens
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVLHSPTSPEPPDTTSPEPPNTTSPESPDTTSPESPDTTSQEPPDTTSQEPPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 1025203 - protein, 743 aa, Homo sapiens
MAVAVRTLQEQLEKAKESLKNVDENIRKLTGRDPNDVRPIQARLLALSGPGGGRGRGSLLLRRGFSDSGGPPAKQRDLEGAVSRLGGERRTRRESRQESDPEDDDVKKPALQSSVVATSKERTRRDLIQDQNMDEKGKQRNRRIFGLLMGTLQKFKQESTVATERQNRRQEIEQKLEVQAEEERKQVENERRELFEERRAKQTELRLLEQKVELAQLQEEWNEHNAKIIKYIRTKTKPHLFYIPGRMCPATQKLIEESQRKMNALFDGRRIEFAEQINKMEARPRRQSMKEKEHQVVRNEEHKAEQEEGKVAQREEELVETGNQHNDVEIEEAGEEEEKEIGIVHSDAEKEQEEEEQKQEMEVKMEEETEVRESEKQQDSQPEEVMDVLEMVENVKHVIADQEVMETNRVESVEPSENEASKELEPEMEFEIEPDKECKSLSPGKENVSALDMEKESDEKEEKESEPQPEPVAQPQAQSQPQLQLQSQSEPQPQLQPEPAQPQLQSQPQLQLQSQCHAVLQSHPPSQPEDLSLAVLQPTPQVTQEHGHFLPERKDFPVESVKLTEVPVDPVLTVHPESESETNTRSRSRGRTRNRTTKSRSRSSSSSSSSSSSTSSSSGSSSSSGSSSSRSSSSSSSSTSGSSSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 1025204 - protein, 77 aa, Homo sapiens
RTLAGTRYLPGYVRSGYILSTKEQCKMHCKVYSMTSFGLKKNLYTNLYLYVVAHARMNIKRCILCESGFYVVNVVRK

SEQ ID NO: 1025205 - protein, 162 aa, Homo sapiens
RTLAGTRYLPGYVRSGYILSTKEQCKMHCKVYSMTSFGLKKNLYTNLYLYVVAHARMNIKGVRKTTDVFTLDTMRNRNEGKEDNNRKSSGPSCNWNANTLNVIDISTKEDLSPTYSDVNLTHVPGNATLLPQCPCGESKLNYMQFHITRLHRKDLMLRNYNS

SEQ ID NO: 1025206 - protein, 102 aa, Homo sapiens
QTLPMEASSEPPLDAKSPVTNQLVDFQWKLGIAFSSDTFRSLKISLRCSYSKSVPDYSGQVKTTCFLNLRVHRFQNFYRQIQGDFCSYLNGVKTGSFVDKIL

SEQ ID NO: 1025207 - protein, 314 aa, Homo sapiens
PGVVLVGLTSAVARGLVSAGWAGGARGGLDEVKPLLPYKQFWWPDSFDLRFFPISKDQPRVLLPLANVALIDYTLEFLTATGVQETFVFCCWKAAQIKEHLLKSKWCLPYIFNVVRIITSELYRSLGDVLRDVDCPRLWCALTFFLVYGDVISTHQYQAEPLSEPQVETEAENKNVSVMTMIFNESSPAPNSLHEDNVVVAVDSTTTGNPKEEPGSLGFELPLSCVGGVIGGAALRRMSNSDLEPSRPQSRTPHTDEIMCSPKMRDADHAAASAGATHENECNANDKQRTKHAYGGECRTTRQERIDGASDRCS

SEQ ID NO: 1025208 - protein, 127 aa, Homo sapiens
HTSAERMASRKAGTRGKVAATKQAQRGSSNVFSMFEQAQIQEFKEAGAAPTLRPHPQAFSCIDQNRDGIICKADLRETYSSWEGSLREQLEDAAEQGPSFKSPTFLGELMDSREHLVLDFTSARVYR

SEQ ID NO: 1025209 - protein, 137 aa, Homo sapiens
HTSAERMASRKAGTRGKVAATKQAQRGSSNVFSMFEQAQIQEFKEVSPHLPPSLELGLLHLKAPIPQAFSCIDQNRDGIICKADLRETYSSWEGSLREQLEDAAEQGPSFKSPTFLGELMDSREHLVLDFTSARVYR

SEQ ID NO: 1025210 - protein, 94 aa, Homo sapiens
HTSAERMASRKAGTRGKVAATKQAQRGSSNVFSMFEQAQIQEFKEVSPHLPPSLELGLLHLKAPIPQAFSCIDQNRDGIICKADLRETYSSWGR

SEQ ID NO: 1025211 - protein, 112 aa, Homo sapiens
LDQTNVSAAARRRKMCLFAGFQRKAVVVGPKDEDYKQRTQKKAEVEGKDLPEHAVLKMKGNFTLPEVAECFDEITYVELQKEEAQNSWSIIRRTAKGSPPEKRQTIGYTERH

SEQ ID NO: 1025212 - protein, 112 aa, Homo sapiens
LDQTNVSAAARRRKMCLFAGFQRKAVVVGPKDEDYKQRTQKKAEVEGKDLPEHAVLKMKGNFTLPEVAECFDEITYVELQKEEAQNSWSIIRRTAKGSSTREETDTAQESIK

SEQ ID NO: 1025213 - protein, 150 aa, Homo sapiens
MGLLTGHLQSAGVKVRTAHAAAVGQLGSQASAGPSLLLSWLALRDKPYPFLTSRCNFFVVPADEAQARIPYARVNHNKYMVTERATYIGTSNWSGNYFRETAGTSLLVTQNGKGGLRSQLEAIFLRDWDSPYSHDLDTSADSVGNACRLL

SEQ ID NO: 1025214 - protein, 150 aa, Homo sapiens; identical to SEQ ID NO: 1025213

SEQ ID NO: 1025215 - protein, 106 aa, Homo sapiens
HLHSCSGHEFISKAKDIMGTLGPRCSGSRSLSPHPRFCLPHCGSSGSLPCSPTSTSTPTGLTLWPRDPAELGEGSAPKEMGVHAGPGPLAHPHFPGQKGPRVIISK

SEQ ID NO: 1025216 - protein, 108 aa, Homo sapiens [sequence omitted]

SEQ ID NO: 1025217 - protein, 515 aa, Homo sapiens
MALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARRFSIN

SEQ ID NO: 1025218 - protein, 203 aa, Homo sapiens
RSRRQHCRRHYPLFLCCSDLDVLPVSHLFAAYMASCSTGRVSCWSDPERFSCALQGYIITDWCARLIKEYGTEQPEETFPNTETNGEFGKRPAEWIWREEQAFKRSRNTDEMVELRILLQSKNAGAVIGKGGKNIKALRTDYNASVSVPDSSGPERILSISADIETIGEILKKIIPTLEAGPEVAIDPLEAASSRSNLMLWNA

SEQ ID NO: 1025219 - protein, 274 aa, Homo sapiens
MQTPLSSVSLLQRPRRLACVPLVRGLYGYCMHWGVSCWSDPERFSCALQGYIITDWCARLIKEYGTEQPEETFPNTETNGEFGKRPAEWIWREEQAFKRSRNTDEMVELRILLQSKNAGAVIGKGGKNIKALRTDYNASVSVPDSSGPERILSISADIETIGEILKKIIPTLERVPTLLKEADFDLRAVKAVDFNHDVYARTDTYFRGVPKKGWALKEKSKQRKTFPGRRSSFKYHAIQTPFMSAQGGKNLAVGSPFEIVPSSETPGKPSGYVR

SEQ ID NO: 1025220 - protein, 85 aa, Homo sapiens
QVDTSGSWVSLALGSGYKRQGPLGVWCRHSMAGALVRKAADYVQGKDFRDYLMSTDFWGPVANWGLPIAAINDMKKSPEIISRDK

SEQ ID NO: 1025221 - protein, 133 aa, Homo sapiens
MAHRGPQRCLLMALATWKSEPGQVKAAVKYALSVGYRHIDCAAIYGNEPESGEALKEDVGPGKGGASGETAVGDIQSCGTPKHHPEDGGAVASGKTLGDLQLQYLGPLYLNGTALLLLEAGENNPFPKEMPDG

SEQ ID NO: 1025222 - protein, 172 aa, Homo sapiens
RLKLRIVGSLAGCRTEPRPQYPIHALCLCQGGNGGFLCLLHTGQKMPLDGSWSTWKSEPGQVKAAVKYALSVGYRHIDCAAIYGNEPESGEALKEDVGPGKGGASGETACWSTFQSCGTPKHHPEDVGAVPSGKTLGAPPAAVSGPLYLNGTALLLLEAGENNPFPQEMPDG

SEQ ID NO: 1025223 - protein, 34 aa, Homo sapiens
MGRLDGKVIILTAAAQGIGKSCLSFCREVPSHSH

SEQ ID NO: 1025224 - protein, 98 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPEP

SEQ ID NO: 1025225 - protein, 157 aa, Homo sapiens
AWVLASSVPNPRTCLRAARDLRSVDSTYHSYRSEIHECTTLLAMTHPGLYSLALIKVYDLTKFLEEHPGGEEVLREQAGGDATENFEDVGHSTDAREMSKTFIIGELHPDDRPKLNKPPETLITTIDSSSSWWTNWVIPAISAVAVALMYRLYMAED

SEQ ID NO: 1025226 - protein, 183 aa, Homo sapiens
AVVRKCIKKDSGKEFAAKFMRKRRKGQDCRMEIIHEIAVLELAQDNPWVINLHEVYETASEMILVLEYAAGGEIFDQCVADREEAFKEKDVQRLMRQILEGVHFLHTRDVVHLDLKPQNILLTSESPLGDIKIVDFGLSRILKNSEELREIMGTPEYVAPEILSYDPISMATDMWSIGVLTYV

SEQ ID NO: 1025227 - protein, 124 aa, Homo sapiens
AVMAGVLKKTTGLVGWAVCQYSSREAKNIVHKDSVSVLRKSLKIAAYRKYTDQITNEKLAMVKAEPDVKKLEEQFQGGQLGRGGIFRADHDLNLGKKNEGMETMGAISGRASCRSVEMANIIIT

SEQ ID NO: 1025228 - protein, 229 aa, Homo sapiens
MAEGNHRKKPLKVLESLGKDFLTVLDNLVDQNVLNWKEEDKKKYYDAKTDKVRVYGQTLKISNWQDKFFFNPFLSYTKYPPILIRIVRLVPPVVQDESTDALKLCPEEFDYLCKERADVIFPIKEELIAHAWLSSLCNTFDHLPWNGADFVITGMMVLLLGLDYIDVEENLARDMEALAFATSEHMTFLVMSHGLERIGFVHYEKNQYVLLYVTIFQIFNNRICSLKFN

SEQ ID NO: 1025229 - protein, 182 aa, Homo sapiens
IRGVTLLVQNHLTSAMALIALGVSHPVLKQVAEQFLNMRGGLGLSGAKANYRGGEIREQNGDSLVHAAFVAEKCVAGSAEANAFSVLQHVLGAGPHVKRGSNTTSHLHQAVAKATQQPFDAPAPNPSHPDPGPLGIHTPPPPDPKAPNNQVKTIAQGKPFQHRCPSCQEQAESWIPNVSGVF

SEQ ID NO: 1025230 - protein, 187 aa, Homo sapiens
IRGVTLLVQNHLTSAMALIALGVSHPVLKQVAEQFLNMRGGLGLSGAKANYRGGEIREQNGDSLVHAAFVAEKCVAGSAEANAFSVLQHVLGAGPHVKRGSNTTSHLHQAVAKATQQPFDVSAFNASHSDSGLFGIYTISQATAAGDVIKAPNNQVKTIAQGKPFQHRCPSCQEQAESWIPNVSGVF

SEQ ID NO: 1025231 - protein, 299 aa, Homo sapiens
MWSQAYSPSNHVQWDLTVGIDLGTTYSCVGVFQHGKVEIIANDQGNRTTPSYVAFTDTERLIGDAAKNQAAMNPTNTVFDAKRLSGRRFEDAVVQSEMTTLGPPWLGEMTAGQAPKGQVELHTGRDQKASIPEEVSPMVPTKMKEIAEAYPGKTVTNAVVTVPAYLNDSQRQATKDAGTIAGLNVPRIINEPTAAAMAYGLDKKVGAERNVLIFDLGGGTFDVSILTIEDGIFEVKSTAGDTHLGGEDFDNRMVNHFIAEFKRNKKDISENKRAVRLRTACERAKRTSSSTQASFEIDS

SEQ ID NO: 1025232 - protein, 64 aa, Homo sapiens
SLGNFKFLLREAENSFPKSFWELFSLYPPPPLRGVEGQFGPARVFPFGVCLAGETGGPGDRAAV

SEQ ID NO: 1025233 - protein, 69 aa, Homo sapiens
SSLAFATAYPDSICKTGKLEMSYSKFKTKSLSFLGTFILKVAESLQLVTVHQSETEDGFTECNNMTLIN

SEQ ID NO: 1025234 - protein, 137 aa, Homo sapiens
FCQPNLDLGYPHLKDFHHNMFQLLLQIKNRAPSCAPFRMGCIRPPLSSPVVPPTVTLQPVIYKYPGPGQSAHGGSIPRTPKNPEKLPKDPSWIIQMSSRGARLHRSPRQYTSELNMKSQKCYCFFQEYYVIECRQSP

SEQ ID NO: 1025235 - protein, 115 aa, Homo sapiens
GVPTAAQVRVAGFCDWCGKSPVGSGHSILLRPQDCCSACPLPEEAAERAPLTGHHVGLLRIVHAAARLILCVSLLGFLATVTLIPAFLGPTSLSARLGQDLNKTSRLAVFQNPRE

SEQ ID NO: 1025236 - protein, 280 aa, Homo sapiens
SKASSTRPPAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTPLMILSASEATVKRVNILSDMHLRSIRTKLMLMSEPEEATKHLECTKQLAAAFHEAICCEKTDLMGLAIGTHGSNIQQARVPGVTAIELDEDTGTFRLYGESADAV

SEQ ID NO: 1025237 - protein, 467 aa, Homo sapiens
MGNRSTADADGLLAGRGPAAGASAGASAGLAGQGAAALVGGVLLIGAVLAGNSLVCVSVATERALQTPTNSFIVSLAAADLLLALLVLPLFVYSEVQGGAWLLSPRLCDALMAMDVMLCTASIFNLCAISVDRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRRPSGPGPPSPTPPAPRLPQDPCGPDCAPPAPGLPRGPCGPDCAPAAPGLPPDPCGPDCAPPAPGLPQDPCGPDCAPPAPGLPRGPCGPDCAPPAPGLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 1025238 - protein, 79 aa, Homo sapiens
QPVSSSEERKGGVPERVACASGECVTSFVTAKRRLRFKNKHKKTKGQKVIPSIFLAETMRSKAKFPDQCRLLVIYGMCL

SEQ ID NO: 1025239 - protein, 103 aa, Homo sapiens
RTAGGAVEPGAGLLSGAEVTPWAAGAVEPGAGLLSGAEVTRTAGGAVEPGAGLVSGAEVTRTDWGGGGARGRPALRGRGDTHGWGGGGARGRPALRGRGDTHG

SEQ ID NO: 1025240 - protein, 165 aa, Homo sapiens
MSGGSADYNREHGGPEGMDPDGVIESNWNEIVDNFDDMNLKESLLRGIYAYGFEKPSAIQQRAINSLYKGYDVIAQAQSGTGKTATFAISILQQLEIEFKGDPSTSIVPPPENWLEQIQKVILALGDYMGATCHACIGGTNVRNEMLKLQAEAPHIVVGTPGRSV

SEQ ID NO: 1025241 - protein, 101 aa, Homo sapiens
IENRFQMKLLVWASAHQRKFHHFATVQKDEGLCSANVTRYYFNPRYRTCDAFTYTGCGGNDNNFVSREDCKRACAKALKKKKKMPKVRFASRIRKIRKKQF

SEQ ID NO: 1025242 - protein, 101 aa, Homo sapiens; identical to SEQ ID NO: 1025241

SEQ ID NO: 1025243 - protein, 101 aa, Homo sapiens; identical to SEQ ID NO: 1025241

SEQ ID NO: 1025244 - protein, 83 aa, Homo sapiens
MNLEEAGGKALAKTPRFTLTQRFFDSFETCVSSAILGNPRSRPCKKVLTSFEMLLKHDTYAALLAEELHCAAACDLRLSSGTY

SEQ ID NO: 1025245 - protein, 328 aa, Homo sapiens
SALLQAEVLDLDEDEDDLEVFSKDASLMDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFIETRRKALHKFLNRIADHPTLTFNEDFKIFLTAQAWELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMNRRDQIQAELDSKVEV

SEQ ID NO: 1025246 - protein, 121 aa, Homo sapiens
MDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFYETSVRDP

SEQ ID NO: 1025247 - protein, 301 aa, Homo sapiens
MDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFIETRRKALHKFLNRIADHPTLTFNEDFKIFLTAQAWELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMNRRDQIQAELDSKVEV

SEQ ID NO: 1025248 - protein, 137 aa, Homo sapiens
MGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMNRRDQIQAELDSKVEV

SEQ ID NO: 1025249 - protein, 328 aa, Homo sapiens; identical to SEQ ID NO: 1025245

SEQ ID NO: 1025250 - protein, 79 aa, Homo sapiens
VDAILSAFRMFDPSGKGVVNKDEFKQLFLTQADKFSPAEVEQMSPDTHGPGGNIDYKSLCYIITMETMKMEMWFKASAH

SEQ ID NO: 1025251 - protein, 125 aa, Homo sapiens
MAAPRSPSPTSSLTWTDFFWILNGCIQWYFKKYSHRYDKKYSWDVKSLVMGKKALEAAQIIIDVLQLPMSKEELVEESQTKLKEVFPTAALNAKGRKKTSSIHTAETWHPPLHLATSPGSRRLFD

SEQ ID NO: 1025252 - protein, 191 aa, Homo sapiens
MAAPRSPSPTSSLTWTDFFWILNGCIQWYFKKYSHRYDKKYSWDVKSLVMGKKALEAAQIIIDVLQLPMSKEELVEESQTKLKEVFPTAALNAKGRKKTSSIHTAETWHPPLHLATSPGVRVVRYEQSRTKSSSACFSTWCSEMTPQCSIGTADPDIFLGVPRGSLPSSYGECLFFEELHLGEAALHLGYT

SEQ ID NO: 1025253 - protein, 575 aa, Homo sapiens
MTQTRRMTFGKICSQESSSLQLTALNEMEDIVQEDGEVVAESGNNTPAHSQAIIPVDVDEEQAGPSGLQRVVKPTSITVHDSESDDEEDSLELQEVWIPKNGTRRYSEREEKTGESVQSRELSVSGKGKTPLRKRYNSHQMGQSKQFPLEESSCEKGCQVTSEQIKADMKAARDIPEKKKNKDVYPSCSSTTASTVGNSSSHYTASQSPDFVRTVNSGGSSEPSPTEVDVSRQCACSPGGSEDSEAMEEGDAESSVCPRCCCHRPQESQRRTSRCSDEERPSTSRACVVNGPDGTRSAFSFRTLPQGGSSGPAHDERTNGSGSGATGEDRRGSSQPESCDVQSNEDYPRRPLTRARSRLSHVLLVSESEVAKTKPRDADGKLAMRDRQYYKSTYYKVILVIEDDHVQVLVLKSKNLVGVTMTNCGITDLVLKDCPKMMFIHATRCRVLKHLKVENAPIVNRFDYAQCKKLNMDQVLDQILRMPPERNRIIYLRPMQQVDTLTLEQKLFSGPYPYHICIIHEFSNPPNVRNKVRIRRLDGTLYANINQELIKYEFFPGRPLRSEGRTLKIPPSTPG

SEQ ID NO: 1025254 - protein, 197 aa, Homo sapiens
GRYEAIDQRLLDRCVDEEISLGDFVLSGGELPAMAMMDAVVRLLPGVLNDSLSAVQDSFADGLLDCPHYTRPEEYDGVRVPDVLLGGHHAEIERWRRQEALRNTLRKRPDLIVRARREKLLSRADEAWLANLAPKRRTPPEAAARAGIGGVVHACAAPDVNPSSIGARPGSRRVPTPTRWQKESVMNLIAKLEQEEI

SEQ ID NO: 1025255 - protein, 252 aa, Homo sapiens
GPQPLPSAADIATMVSGSSGLAAARLLSRSFLLPQNGIRHCSYTASRQHLYVDKNTKIICQGSTGNQGTFHSQQDIGHYGTKLVWRNHSRERRPDTSGLTCLYYCEGGQRTDRSNGSLSSMFLRLLLLLPLSEAIEAEIPLACVLSLKEFPSQDMVRRHSTNCCATEHTTKAYSRPNLALAAHQSLENSLNNWPSCLGHIHHHKERIGIVYRSGTLTLKQFTKQRTSPWGRLSALPLAGDPYNGTDSLDCLD

SEQ ID NO: 1025256 - protein, 54 aa, Homo sapiens
TVEYMVSVYAQNPSGESQPLVQTAVTTIPAPTDLKFTQVTLHSYIHVMLNIWCG

SEQ ID NO: 1025257 - protein, 230 aa, Homo sapiens
MALLVDHIYAIREAATSNLKKLEKFGKEWAHATIIPKVLAMSGDPNYLHRMTTLFCINVLSEVCGQDITTKHMLPTVLPMAGDPVANVLFNVAKSLQKMAPILDNSTFQIEVNPILEKLTQDQDVDVKYFAQEALLFFLSPDAGRGANTGLWCPPSNPHKSLFGETLGGLWVSLPVHGLTPGPFPQHGSSSPQPGKISHCPPPNGLGEHGVGQDSDLGRKGLLLPRQGEM

SEQ ID NO: 1025258 - protein, 287 aa, Homo sapiens
MAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAGGCATFLCQPLDVLKTRLMNSKGEYQGVFHCAVETAKLGPLAFYKGLVPAGIRLIPHTVLTFVFLEQLRKNFGIKVPS

SEQ ID NO: 1025259 - protein, 296 aa, Homo sapiens
MAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAAAGDEPPPQGGCATFLCQPLDVLKTRLMNSKGEYQGVFHCAVETAKLGPLAFYKGLVPAGIRLIPHTVLTFVFLEQLRKNFGIKVPS

SEQ ID NO: 1025260 - protein, 160 aa, Homo sapiens
GRFKAPGPPQSQGAWPSGPAPGARARIGCAGCGRAGGALNRARGAGRGALRPVHAGVGPGSGCGRAGIGLSWAMAAEARVSRWYFGGLASCGAACCTHPLDLLKVRPGPGTRGGWDPGAAETPAKAAARPHAPGDRRARGSLLESARRAPTPGWPIPGGP

SEQ ID NO: 1025261 - protein, 287 aa, Homo sapiens; identical to SEQ ID NO: 1025258

SEQ ID NO: 1025262 - protein, 241 aa, Homo sapiens
MALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAGGCATFLCQPLDVLKTRLMNSKGEYQGVFHCAVETAKLGPLAFYKGLVPAGIRLIPHTVLTFVFLEQLRKNFGIKVPS

SEQ ID NO: 1025263 - protein, 476 aa, Homo sapiens
GRFKAPGPPQSQGAWPSGPAPGARARIGCAGCGRAGGALNRARGAGRGALRPVHAGVGPGSGCGRAGIGLSWAMAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLWMCHVPVPAPGCAEDSPDELQGGVSGRFPLRRGDSEARASGLLQGPRPSWHPPHPPHRAHFCVSGTATQKLWHQSAILTSRGNGWAARPDTLGSSKESQAQHLLLGPRPPWPWPPVLRSRPLLSPHLLAELLLASSPLSCSCTTPALATRLSRLGTAWPCPSPAGSSSGEQGLPEADFSPLLGQGRGIIPASCPRCPKQHLPALSIEDLGGRVWVQPGCCSPKC

SEQ ID NO: 1025264 - protein, 287 aa, Homo sapiens; identical to SEQ ID NO: 1025258

SEQ ID NO: 1025265 - protein, 50 aa, Homo sapiens
RLILQLLKLSPQFSIMSEPIRVFVTGAAGQIHIRAYNSCAVGITPRPWTV

SEQ ID NO: 1025266 - protein, 649 aa, Homo sapiens
MAPGEKIKAKIKKNLPVTGPQAPTIKELMRWYCLNTNTHGCRRIVVSRGRLRRLLWIGFTLTAVALILWQCALLVFSFYTVSVSIKVHFRKLDFPAVTICNINPYKYSTVRHLLADLEQETREALKSLYGFPESRKRREAESWNSVSEGKQPRFSHRIPLLIFDQDEKGKARDFFTGRKRKVGGSIIHKASNVMHIESKQVVGFQLCSNDTSDCATYTFSSGINAIQEWYKLHYMNIMAQVPLEKKINMSYSAEELLVTCFFDGVSCDARNFTLFHHPMHGNCYTFNNRENETILSTSMGGSEYGLQVILYINEEEYNPFLVSSTGAKVIIHRQDEYPSVEDVGTEIETTMVTSIGMHLTESFKLSEPSSQCTEGGSDVPIRNIYNAAYSLQICLHSCFQTKMVEKCGCAQYSQPLPPAANYCNYQQHPNWMYCYYQLHRAFVQEELGCQSVCKEACRFKEWTLTTSLAQWPSVVSEKWLLPVLTWDQGRQVNKKLNKTDLAKLLIFYKDLNQRSIMESPANSIEMLLSNFGGQLGLWMSCSVVCVIEIIEVFFIDFFSIIARRQWQKAKEWWAWKQAPPCPEAPRSPQGQDNPALDIDDDLPTFNSALHLPPALGTQVPGTPPPKYNTLRLERAFSNQLTDTQMLDEL

SEQ ID NO: 1025267 - protein, 101 aa, Homo sapiens
VQATLRADPPLYQRTLPTSSSEFICDSRVPQLHRAGVVGKGPTRVLLCSPRWKHVSSRVKADGCPGGTSPRTSVLTMLLSQLLSSLTCPKPLPAGWKHEAG

SEQ ID NO: 1025268 - protein, 143 aa, Homo sapiens
QLMYYFNTLTYRILPSKAKKFGTRVDARQPVDPPDELDIARAPRRIGPHRLHVALDRDGVDGSSHDSGRCTMRFGTRMSATSGNSRSAACRCASSVGERHVRASNWICSERIPGVRSSMRAAGARRASTSAHEPKAQVQVEHT

SEQ ID NO: 1025269 - protein, 151 aa, Homo sapiens
QPGVLPLKPYGPVFVVELLGGYQFSPRGTSYYIITNFKNGSQIGILALEAKNWAQGMAGKQAVSASGKWLDGIRKWYYNAAGFNKLGLMRDDTIYEDEDVKEAIRRLPENLYNDRMFRIKRALALNLKHQILPKEQWTKYARGKISTLTRF

SEQ ID NO: 1025270 - protein, 57 aa, Homo sapiens
MAQSINITELNLPQLEMLKNQLDQEVEFLSTSIAQLKVVQTKYVVSQGMFDTSRNRA

SEQ ID NO: 1025271 - protein, 32 aa, Homo sapiens
ASTNQTSMYFCASSCRGTGELFFGEGSRLTVL

SEQ ID NO: 1025272 - protein, 32 aa, Homo sapiens
ASTNQTSMYFCASSYSGGAHEQYFGPGTRLTV

SEQ ID NO: 1025273 - protein, 440 aa, Homo sapiens
GEGLRRSSRSMSEWREGLSLSSTAHRVSGGRACQLSSRSTKDWREGLSHLQQEHEEWTARTVHISSTCTTEWRESLSLQKEHQEWTADPSLSSTCTKEWREGPLLSSKKHQGSEVGPVALQHVPPRQWREGPSLSSMSNPEMEEGSAICQALRVKSCDFISYQLLLSLSLRMKLASPAQEQCCLLPVLLLDCRGKSQTNLFHTLGISCINAISACSRTQYCLNNVLGVTKFITCRPDGRKAWGGGVPACIAAVRAAQSLRHPAMASAHQATSLRSSESFQFFLGHLNATVSTKSCRITLIGSDKPRFEPLSPPSKPLAREHRISFLEHVFCEGPEAIFEASWATCCPCCISFFLFGLVNCLSWQNNRTRTFSTQPSALGHAGLCLLPALEAQGLAWASRPEPPMYIAPILGTPPGSAARPPRTSFCSPGRALLTPKSAIF

SEQ ID NO: 1025274 - protein, 70 aa, Homo sapiens
FHPVTTQIKDARRLTSSFRSSSLMTVNTSSHQTSLGDPDKLCPGQPLKHPSPHQARMIFPIRLHNSPIRP

SEQ ID NO: 1025275 - protein, 30 aa, Homo sapiens
ICVLLCQQPLDSQGSSDEQFFGPGTRLTVL

SEQ ID NO: 1025276 - protein, 59 aa, Homo sapiens
MDDIYKAAVEQLTEEQKNEFKAAFDIFVLGAEDGCISTKELGKVMRILARPPPEELQRY

SEQ ID NO: 1025277 - protein, 224 aa, Homo sapiens
KQEAPTGAQEECAPPGDANRARHGVETQHRLQQLSELRAPGGAPAAKPQPGHPKWQQHCHNFSIIAESGSTLRSWSPTDSSTARRIEELQHNLQKKDADLRAMEERYRRYVDKARMVMQTMEPKQRPAAGAPPELHSLRTQLRERDVRIRHLEMFEKSRSQREQEEKLLISAWYNMGMALQQRAGEERAPAHAQSFLAQQRLATNRRGPLGRLASLNLRPTDKH

SEQ ID NO: 1025278 - protein, 125 aa, Homo sapiens
RFVHFYDMEIIEEEAFLAWKEDITQEFPGKGKALFQVNQWLTWLETAEEEESEEEADKRTSQSLKLCITFCFYDVTAFDLTTAKTHSAVMFSQYFKAEARQLGFPSAEGLWCSVMSVIIVYHQIF

SEQ ID NO: 1025279 - protein, 134 aa, Homo sapiens
MGNGIRPPHEKPLRGKASQEMPKHAGGARRQAGSVMPQPPPKEGTGKTGDATPQAPKQRQPARPPPAAHRPPQARKLNSNTEYCRNALCSVILELLQYLIIHLVVTEKFLTVIDGCCRNSILPVFLPLVMGFMC

SEQ ID NO: 1025280 - protein, 125 aa, Homo sapiens; identical to SEQ ID NO: 1025278

SEQ ID NO: 1025281 - protein, 323 aa, Homo sapiens
VDNGQLSLIHTQMATSASIHSMPTGTIPPPTTIKATGSTHTAPGMTLTPVGPANPQAHLARPKLLHPYLTTLPPHTIREVTPTSTTNITPNHTSTGTRTPVAHTTSATSSRLPTPFTTHSPPTGSSPISSTGPMTATSFQTTTTYPTPSHPQTTLPTHVPPFSTSLVTPSTHTVITPTHAQMATSASIHSTPTGTIPPPTTLKATGSTHTAPPMTLTTSGTSQALSSFSTAKTSTSLHSHTSSTHHPEVTSTSTTNITPNPTSTGTPPMTVTTSGTSQSRSSFSTAKTSTSLHSHTSSTHHPEVTSTSTTSITPNHTSTGTRS

SEQ ID NO: 1025282 - protein, 241 aa, Homo sapiens
VDNGQLSLIHTQMATSASIHSMPTGTIPPPTTIKATGSTHTAPGMTLTPVGPANPQAHLARPKLLHPYLTTLPPHTIREVTPTSTTNITPNHTSTGTRTPVAHTTSATSSRLPTPFTTHSPPTGSSPISSTGPMTATSFQTTTTYPTPSHPQTTLPTHVPPFSTSLVTPSTHTVITPTHAQMATSASIHSTPTGTIPPPTTLKATGSTHTAPPMTLTTSGTSQALSSFSTAKTSTSLTLPR

SEQ ID NO: 1025283 - protein, 678 aa, Homo sapiens
RSIIADRPGYWPEHTPSESQPSSPSPTPSHPQTTLPTHVPPFSTSLVTPSTHTVITPTHAQMATSASIHSTPTGTIPPPTTLKATGSTHTAPPMTLTTSGTSQALSSFSTATASSSFISSSSWSSWLPQNSSSRPPSSPITTHHSSHLEFCNHSCFHNYSAVLLIFSQSFCPLYCFFLCALLPLLSPDFIAFCWHIFLFRVRPRALHNPELGVTLLIVHSSHDWIRVCISSFSFFSSCSTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQHAWSCPAPIPARLAGGSYSPCRCSATACAALWPVETSRVAACSPGAEGLQMTDRKTPTSPLPACASSCFPGHQAWPPSALGRGSLGHRLERGCQAGAQTTTLLQTLSQQRGTEADSGHGPPRHTGHSRPPLPTVQHLPAPELGPSPAVAQNPADEATEQALDQTHQGRGGHGNLCRDGGKRPRQPPAQRRGDPQSQGGQRVAARAGQPPPLPARQKAPTSTTPIPSSLSLGEGVTRSETP

SEQ ID NO: 1025284 - protein, 142 aa, Homo sapiens
MATSASIHSTPTGTIPPPTTLKATGSTHTAPPMTLTTSGTSQALSSFSTAKTSTSLHSHTSSTHHPEVTSTSTTNITPNPTSTGTPPMTVTTSGTSQSRSSFSTAKTSTSLHSHTSSTHHPEVTSTSTTSITPNHTSTGTRS

SEQ ID NO: 1025285 - protein, 223 aa, Homo sapiens
TTSATSSRLTTPFTTHSPPTGSSPISSTGPMTATSFQTTTTYPTPSHPQTTLPTHVPPFSTSLVTPSTHTVITPTHAQMATSASIHSTPTGTIPPPTTLKATGSTHTAPPMTLTTSGTSQALSSFSTAKTSTSLHSHTSSTHHPEVTSTSTTNITPNPTSIGSSTPMAHTTSATSSRLTTPFTTHSPSTGSSPFSSTGPMTATSFQTTTTYPTPSLSQTTLPT

SEQ ID NO: 1025286 - protein, 668 aa, Homo sapiens
VDNGQLSLIHTQMATSASIHSMPTGTIPPPTTIKATGSTHTAPGMTLTPVGPANPQAHLARPKLLHPYLTTLPPHTIREVTPTSTTNITPNHTSTGTRTPVAHTTSATSSRLPTPFTTHSPPTGSSPISSTGPMTATSFQTTTTYPTPSHPQTTLPTHVPPFSTSLVTPSTHTVITPTHAQMATSASIHSTPTGTIPPPTTLKATGSTHTAPPMTLTTSGTSQALSSFSTATASSSFISSSSWSSWLPQNSSSRPPSSPITTQLTPLEFCNHSCFHNYSAVLLIFSQSFCPLYCFFLCALLPLLSPDFIAFCWHIFLFRVRPRALHNPELGVTLLIVHSSHDWIRAASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLGCPAPIPARLAGGSYSPCRCSATACAALWPVETSRVAACSPGAEGLQMTDRKTPTSPLPACASSCFPGHQAWPPSALGRGSLGHRLERGCQAGAQTTTPPADPEPAERD

SEQ ID NO: 1025287 - protein, 178 aa, Homo sapiens
KSSSNFSSKTSKLKEHCNPEAKKPCPGKFLKRGEPSVAGTPSHPVFLRLTVAHVVPRTMASSSLSKLQGLLNVIHGFSPERGVLLNIFQGLQGRSLGDEAPSGPLQLLEGAGAAALAWLLQGAVVLRSRPGEGDGQDSLSERVEASPTAAPTPGGPGAQKGGRRHLHADKGIVLLQLL

SEQ ID NO: 1025288 - protein, 227 aa, Homo sapiens
MAVTALAARTWLGVWGVRTMQARGFGSDQSENVDRGAGSIREAGGAFGKREQAEEERYFRCWLTGYPSPDLDLPMAFQILKLSIAPTRFLAGALGGPIAAIEFPGAQSSIRLTLDVPNSLPRSRALPVYLRQLVFRPPQTVFHRAGLRITNPTASTPSLYQLPVSPLWQFVLRVVEEHAPDFFVTVSRSDPRQTSELPSLRSPRSLYRDLLRPPSYGSSFPSPSDAR

SEQ ID NO: 1025289 - protein, 105 aa, Homo sapiens
MAVTALAARTWLGVWGVRTMQARGFGSDQSENVDRGAGSIREAGGAFGKREQAEEERYFRATELENNWSALKRSSHEEEIFIIKKEIDASAERKLSRHKQQDHQC

SEQ ID NO: 1025290 - protein, 82 aa, Homo sapiens
MESRSVAQAEWNGANSAHCNLHLPRLKRLSCLSLLSSWDYRCPPPRPANFCIFSRDGVSPCWPGWSRTPDLVIHPPRPPNNL

SEQ ID NO: 1025291 - protein, 82 aa, Homo sapiens; identical to SEQ ID NO: 1025290

SEQ ID NO: 1025292 - protein, 196 aa, Homo sapiens
MTATSIKTTTTYPTPSHPQTTLTTHVPPFSTSSVTPSTHTVITPTHAQMSTSASIHSTPTGTVPPLTTRMPTGSTRTGPPMTGTIIQTSKAHNSFSTAKTSTSLHSHASSTHHPETTPTSTTNITPKSTSAGTSTPVAHTTLATSSRLPTTFTTHFPPTGSSHVSSTGPMTATSSQTTTTHPPPSHPQTTLPTHVP

SEQ ID NO: 1025293 - protein, 505 aa, Homo sapiens
STSLVTPSTHTVIAPTHAQMATSASIHSAPTGTIPPPTTLKATGSTHTAPPITPTTSGTSQAHSSFSTNKTPTSLHSHTSSTHHPEVAPTSTTTITPNPTSTRTRTPVAHTNSATSSRPPPPFTTHSPPTGSSPFSSTGPMTATSFKTTTTYPTPSLPQTTPLTHVPPFSTSLVTPITHTVITPTHPQMSTSAYIHSTPTGTIASPTTVKATRSTYTAPLMTATTSRISQAHSSISTAKTSTSLHSHASSTHHPEVTPTSTTNVTPKSTSRDTSTPVTHTTSATSSRPPTPITTHSSPTRSSPLSSTGPMTATSIKTTTTYPTPSHPQTTLTTHVPPFSTSSVTPSTHTVITPTHAQMSTSASIHSTPTGTVPPLTTRMPTGSTRTGPPMTGTIIQTSKAHNSFSTAKTSTSLHSHASSTHHPETTPTSTTNITPKSTSAGTSTPVAHTTLATSSRLPTTFTTHFPPTGSSHVSSTGPMTATSSQTTTTHPPPSHPQTTLPTHVP

SEQ ID NO: 1025294 - protein, 282 aa, Homo sapiens
MSLHQFLLQPIHLSCLESVARTQNCPQYPDNHDVHLYKNEREPEGERSELKDHNGDITGIDWAPKSDRIVTLWGSRNAYVWSHNRWCEEANPGDPDELIAQLTFVKWSPLENNFAVGSGARLISVRNFESENDWWVSKRHETSRFAPQSSVLDSAFPTDVSAGTQDHVTSQCRSVTLPTITQTWLHQAEPARPWGSTDALWGSLLSKAQLPCVHLSGLRPTGGQDLRVPTEDPAFGQASGHGRANRLLRADVLSNTPQAPERRKHTTFTAHTIRGPLSVQKN

SEQ ID NO: 1025295 - protein, 51 aa, Homo sapiens
MVPWVEGGNRARSSPWVAINVSWDIRTLPSTSMTLGGDFSSAAIYFRRAHH

SEQ ID NO: 1025296 - protein, 142 aa, Homo sapiens
MVQVGGTAKKPEEPRSARVTLLSQSKSGFWFGAEKPGGLAFPRKAPPLPWPREQTKSTAGPITLGALRPAMVMEVGTLDAGRLRALLGERAAQCLLLDCRSFFALQDGHIAGSVNVRFRPSCAPAKGPWAWRHRAQHARVRG

SEQ ID NO: 1025297 - protein, 626 aa, Homo sapiens
MPLLLLLLLLPSPLHPHPICEVSKVASHLEVNCDKRNLTALPPDLPKDTTILHLSENLLYTFSLATLMPYTRLTQLNLDRCELTKLQVDGTLPVLGTLDLSHNQLQSLPLLGQTLPALTVLDVSFNRLTSLPLGALRGLGELQELYLKGNELKTLPPGLLTPTPKLEKLSLANNNLTELPAGLLNGLENLDTLLLQENSLYTIPKGFFGSHLLPFAFLHGNPWLCNCEILYFRRWLQDNAENVYVWKQGVDVKAMTSNVASVQCDNSDKFPVYKYPGKGCPTLGDEGDTDLYDYYPEEDTEGDKVRATRTVVKFPTKAHTTPWGLFYSWSTASLDSQMPSSLHPTQESTKEQTTFPPRWTPNFTLHMESITFSKTPKSTTEPTPSPTTSEPVPEPAPNMTTLEPTPSPTTPEPTSEPAPSPTTPEPTPIPTIATSPTILVSATSLITPKSTFLTTTKPVSLLESTKKTIPELDQPPKLRGVLQGHLESSRNDPFLHPDFCCLLPLGFYVLGLFWLLFASVVLILLLSWVGHVKPQALDSGQGAALTTATQTTHLELQRGRQVTVPRAWLLFLRGSLPTFRSSLFLWVRPNGRVGPLVAGRRPSALSQGRGQDLLSTVSIRYSGHSL

SEQ ID NO: 1025298 - protein, 120 aa, Homo sapiens
SIEVLMGRAIPRERHSPNNLKEQHHIRGSITQGIPRSYVEAQEDYLRREAKLLKREGTPPPPPLTGPDRGLQDAALGPLKLNGRHEALVATVKEAGRSIHEIPREELRTRPSCPLATASR

SEQ ID NO: 1025299 - protein, 313 aa, Homo sapiens
TPSGKRRKKKKERNTRFARVHTDPTTRTKGAWEAYTPAPRHSRYSQGQPVRAGTILAGSGWRTQPEYGNSRATIRCHTPVLELPSPRSRGRTGARQARVLALLLIPGAAWAAAGAPFLPSARQSSLSARFSRSSSFWRPSSSASFCQQPPRSSRTARDAWVPKSCHRACGAAPLALRVQEAAEGAQLTVLCLQTPVELLELADLAQVALQLPIHLLHEAAAAAPVPPGAAQHIISRQQAHALAIFHCTSSTAHRPSVTSSITHRPAHAIRHITMAGQALWSISTSHASTAGTHGATTSGPGAHSGSGLQAHST

SEQ ID NO: 1025300 - protein, 237 aa, Homo sapiens
NSQIWRHKVIWHLLGHSLGAYISTLDKEKLRKLTNRILFRYHLMAMQKLSDHENGCAYYPRRGKRRTCQRYVGLPFILDMKHFVVDGFNVLYNKKPVYILDAAARHWPGPIPYVISIGLPFPCCAVYPCNTVIGSQHQMDVAFLDETDYKMIIRARKTAPVACRTCRQRGHHVGTTQTQIVEIDKNSVKRNGIIGFMLQRCEFWPPLGSGDICLLNKMQAEDKMDSKKNNPGRGRVA

SEQ ID NO: 1025301 - protein, 191 aa, Homo sapiens
VSSAKRSLRELKQRLRAMSAEERLRQSRVLSQKVIAPSEYQKSKSISIFLSMQDEIETEEIIKDIFQRGYICFIPRYRFQSNHMDMVRIESPEEISLLPKTSWNIPQPGEGDVREEALSTGGLDLIFMPGLGFDKHGNRLGRGKGYYDAYLKRCLQHQGSEALHPGGWLSKNRFSFSVMKRHEVDEALRNS

SEQ ID NO: 1025302 - protein, 67 aa, Homo sapiens
RVTEVQAPASGTAAGTRGRAAPAHGQARCFPPGRPAVTITALPSQVTVLDSALTRSPRWAGNTDEDG

SEQ ID NO: 1025303 - protein, 46 aa, Homo sapiens
SLNLALRRFHALQVLLVVEVALVEGRREVGQHRVRTSQRVRQVLPA

SEQ ID NO: 1025304 - protein, 81 aa, Homo sapiens
EVSGSNEKTILPCLPQVVEINVKWLNPPKNPRLPWPTLPSHEAVTQNPSEETPTPSQYPPKVVLCHVCSLPAQTYMYITMD

SEQ ID NO: 1025305 - protein, 240 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMAFSKKPVTRIGNIHSSTVVIPTFRIAGATFDRTVNEVSKTYTLEEARRTSKSVLMEHFGEQKGPVYVACQFPISLLQACEWYELILILVFSRKPCMLVTMNRILGYSLKGGARLDGSHALKDIPNVGVNLIRMTTPTFPYWHKTAVGFTRPVAQKKAP

SEQ ID NO: 1025306 - protein, 115 aa, Homo sapiens
IFLPHQTAVSSPASLCHSSSLWEDDVKEHPERGREKRDSGYASLAPHPPGPPLDPLFPQTRAHHARPLGRQDSISPPPSKNPGYVGRSRAVVRKRTKEGSDTGWGHLARPAKPGH

SEQ ID NO: 1025307 - protein, 133 aa, Homo sapiens
SGSALFAVAYEAYSAACSRGSLCPAWCLFCSGFLRSVVGPVTVFGPVLPARIGGMYFPCPHVPSLLALQYCILTSVSRLLCPLLPAFRSSLSFPVTPGCGVPEPFRGTATPSCLCHSHLCPSFPRYTIRCLWH

SEQ ID NO: 1025308 - protein, 111 aa, Homo sapiens
TNLIYFTALSTSTMTHYSEQFPTPHRPLWCVSPDPLVCMAPRVPVWSKLTWVTITTLSTLGHPNSQSLSFFILMILQVLSVSQDSVRVVFLKTFRGAGLHGHMGEMVTLRG

SEQ ID NO: 1025309 - protein, 157 aa, Homo sapiens [sequence omitted]

SEQ ID NO: 1025310 - protein, 165 aa, Homo sapiens
VGKAIEEELQEIASEPTNKHLFYAEDFSTMDEISELKKGICEALESFRQDSPAGELPKTVQQPTVQHRYLFEEDNLRSTKLSHSTKPSEPLRAKSTTMQMCPYNVPEPKRRSKINTALRRNDTENGSPGKSPEIQMKISKSRSIGSHCITDNENARGQAIKSIML

SEQ ID NO: 1025311 - protein, 316 aa, Homo sapiens
AGWYWSPSRYIEFFQNVSMVLLPPQVPECRQGPTHHPYGTNRCMQEQRRWQLGCTGDGQRTREFTHIWHCPLVRSVPGVDQLGWSTLQDSCVVNPVKLGRVKLELPMLELIAAGELRLGKKGTDRYRMVVGGAQAGDAGTYHCTAAEWIQDPDGSWAQIAEKRAVLAHVDVQTLSSQLAVTVGPGERRIGPGEPLELLCNVSRGTSPSRPSCCILCRSGDGTCGGTLGPCRLVAQLEHRGMWAAWALGYEGRHIAMEEGGIQNIPVRLEAARPGDAGTPTPSPKPMFEGLGPGFREASARSRPLPVTCGKKVRGGL

SEQ ID NO: 1025312 - protein, 248 aa, Homo sapiens
AGWYWSPSRYIEFFQNVSMVLLPPQVPECRQGPTHHPYGTNRCMQEQRRWQLGCTGDGQRTREFTHIWHCPLVRSVPGVDQLGWSTLQDSCVVNPVKLGRVKLELPMLELIAAGELRLGKKGTDRYRMVVRGCPGRGRSAPTTALPLSGFRILMAAGPRLQRKGPSWPTWMCRRLCKCPLIHPTVGAGKGTVSWWALWTGGTQIAHHTDSKELIFPQKLQPLAFLSPGPLNGFSLQKLGRDRQAPCLG

SEQ ID NO: 1025313 - protein, 257 aa, Homo sapiens
AGWYWSPSRYIEFFQNVSMVLLPPQVPECRQGPTHHPYGTNRCMQEQRRWQLGCTGDGQRTREFTHIWHCPLVRSVPGVDQLGWSTLQDSCVVNPVKLGRVKLELPMLELIAAGELRLGKKGTDRYRMVVGGAQAGDAGTYHCTAAEWIQDPDGSWAQIAEKRAVLAHVDVQTLSSQLAVTVGQPGALGYEGRHIAMEKVASRTYRLRLEAARPGDAGTPTPSPKPMFEGLGPGFREASARSRPLPVTCGKKVRGGL

SEQ ID NO: 1025314 - protein, 143 aa, Homo sapiens
TPALASQSAGITGGRHCARLENNYYCSRFLGSYYVLRAPCSASQSSFLVYPPRFEDEWPLPSATITCSFSSILSSGSIRTLRSECSWLGKAQEPHPGSPPTDPTSNHDMLQPPQWPEQLNKASLFPFCTPENSCVGLFAMQSE

SEQ ID NO: 1025315 - protein, 46 aa, Homo sapiens
MGSRTQGPRGGGLKPLCSHVAKLSSWRGWARHHLVRMFRGSAGFRG

SEQ ID NO: 1025316 - protein, 172 aa, Homo sapiens
MVEKKTSVRSQDPGQRRVLDRAARQLRINRQLEALENDNFQDDPHAGLPSVSGKKTASVLMTYADTGNEREENPRLINFKHSLPKKSFQSPVWAVSQNCESLADVALNLSSYGLVPGSPLSAGSLAAPFLGACLVCFTDPPLHAGVTLAGASELQHVQHDHEWTPNRETKVI

SEQ ID NO: 1025317 - protein, 237 aa, Homo sapiens
LPQGVTRALPFNRKRLPAHPTPLLHDCMLLMHHMRTCDQMSDCPVMLDVTGCATVMPEIFVLANLWMSLRAVPPGETGRSLVRAQPLSVTVCGSSLPEASPALPLSLPCPNCLWSLKPSLRPELGLRGPGAASRARTRERSAFRPKLKRAPHQGPAGSRLGPETFRQRFRQFRYQDAAGPREAFRQLRELSRQWLRPDIRTKEQIVEMLVQEQLLAILPEAARARRIRRRTDVRITG

SEQ ID NO: 1025318 - protein, 594 aa, Homo sapiens
MKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPKHPCRSHGSPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPAPPGEHSGIPFPTPPPPNCFMGNISQQMVGDDGDTIRSTTSKVISRRMIANTKR

SEQ ID NO: 1025319 - protein, 285 aa, Homo sapiens
MKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGQ

SEQ ID NO: 1025320 - protein, 641 aa, Homo sapiens
MKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPAPPGEHSGIPFPTPPPPNCFMGNISQQMVGDDGDTIRSTTSKVISRRMIANTKR

SEQ ID NO: 1025321 - protein, 248 aa, Homo sapiens [sequence omitted]

SEQ ID NO: 1025322 - protein, 120 aa, Homo sapiens [sequence omitted]

SEQ ID NO: 1025323 - protein, 144 aa, Homo sapiens
PPPSSSQHGYYGKTLPREVTLPKSRMSPKKICKGPRKESQLSLGGQSCAGEPDEELVAAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 1025324 - protein, 114 aa, Homo sapiens
PPPSSSQHGYYGKTLPREVTLPKSRMSPKKICKGPRKESQLSLGGQSCAGEPDEELVAAFPIFVRNAILGQKQPKRPRSESSCSKDVVRTGFDGLGGRTKFIQPTDSFCDVELG

SEQ ID NO: 1025325 - protein, 114 aa, Homo sapiens; identical to SEQ ID NO: 1025324

SEQ ID NO: 1025326 - protein, 189 aa, Homo sapiens
AAEPAPSAPSPAPSRVRAKQQPPTPGPGRGTSSFPTGNVRRACAQKQDEKMANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPSSESGCEDSGSLISFAVNTC

SEQ ID NO: 1025327 - protein, 2016 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPVRRAAVKILVHSLFNMLIMCTILTNCVFMAQHDPPPWTKYVEYTFTAIYTFESLVKILARAFCLHAFTFLRDPWNWLDFSVIIMAYTTEFVDLGNVSALRTFRVLRALKTISVISGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTARESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRHRPQKPAALAAQGQLPSCIATPYSPPPPETEKVPPTRKETQFEEGEQPGQGTPGDPEPVCVPIAVAESDTDDQEEDEENSLGTEEESSKQQESQPVSGWPRGPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 1025328 - protein, 141 aa, Homo sapiens
KRPIENRLILPSVTRNETGPYQCEIQDRYGGIRSNPVTLNVLYGPDLPRIYPSFTYYHSGENLYFVLFADSNPPAEYSWTINGKFQLSGQKLFIPQITTKHSGLYACSVRNSATGMESSKSITPKVSAPSGTGHLPGLNPL

SEQ ID NO: 1025329 - protein, 179 aa, Homo sapiens
MCLWEFQSCNDFWLVPEVYLTVCVKSDKKTSRKKGSSLFNPNHGTINTHGLILGSTPNTTPNTTTPTTPTPHHTTRTPHITHTTPTKALGAAPPPQIKHTGGAPPQKTIRLACLQDHRSNIVGSPTKHRRGTCRQPTAGGSVHTPPDTPPVYQQHNRARARHTRGRHSTDPTQPQHPEN

SEQ ID NO: 1025330 - protein, 104 aa, Homo sapiens
MPAIAFPGGIGTLPLADLAKRRFFDVLQAMLRGEYSAPPMAKTLSFALHEVEPNRVVFKGVPAQEHLQSIRVRHPAAIELPPGAGSIIPLGGISLAVGWDFYGI

SEQ ID NO: 1025331 - protein, 121 aa, Homo sapiens
TSNSEYTFPVSAVQPLLSIPQFLPRVSVLGGFSGIIQPSPTSLPSAHPLSCLREISLKLQIGSPSCLTSFSLHPHAQVVRVRGKQLDVSTAQTEGQPWLSAYPLNAFRQVTQLAKPSFLQL

SEQ ID NO: 1025332 - protein, 103 aa, Homo sapiens
HKHANPQGYYDMNSWYEHCRLVTGLANTGEYQSNPTLLRLYYSRASRGQSDVKKVPKGVPLQFDINSVGKQTGMTLNERFGILKEQRATLTYNKGGSRFVTVG

SEQ ID NO: 1025333 - protein, 111 aa, Homo sapiens
GELGIIICTRCCKRWGCSLVKYAERQQLDRMIARATRDLTSGRSGLSARFMRDFGLDDQNRPRHAADDGVTKEMYEYPGVQHHVKPAVHFLKRRNIGTVGLDLFTFFILAC

SEQ ID NO: 1025334 - protein, 99 aa, Homo sapiens
LDLRNLPRRQQDSTQQLRIRLRQLPDVPIPLPRHHEHMHPRLRDVPKRKRGVVLIHDVRRNLPSNNPLEQRLRRIAHTRHPTNPHWPRRRTHATPPHPR

SEQ ID NO: 1025335 - protein, 143 aa, Homo sapiens
MATILTSNQRPPAAPRPGGRRTPAWMNLTSIPWPIPTSEVEAGKVAPREKLLPTPTAPPCGHKRKLVTKLQNSEREKPGARRSNRAGDEARPWTLHPAIDTALRRKEDPAQPPLATPPPSTHSRSLSLSGATRKAPPTLRKTC

SEQ ID NO: 1025336 - protein, 246 aa, Homo sapiens
VTDPQRSRCCLRDPQRVLEYCRQMYPELQIARVEQATQAIPMERWCGGSLERQLAQPHQQVVPFLCLLGEFVSEALAGCLKGWPVSCTRSAWTNVRVQPGGIRRHKEACSSQGSSCNGSGMLLPCGSDRFRGVEYVCCPPPGPPTHRGTAVGDPIHPVLAPGEQSKRKLQDEEEEESFPTEQENEYFVEPPQLEEEEATVPPPSSHTLASGRQSHSHPEAHRTVWILHWHAGDISEPRVREAKGPG

SEQ ID NO: 1025337 - protein, 134 aa, Homo sapiens
TLQRSCNSEKIPKIPKKFGEKGLRRTLLNPWGNQELGKIRNTEPRPGPLSPGYSGQEVRLGSGGHLHLRISRAALPSGSPSLPPSPGSVPAVPDGVKVVGRDTTLRRQLSLARPPWARAAPSTVAAAVAVTNCW

SEQ ID NO: 1025338 - protein, 570 aa, Homo sapiens
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGIKVTDAPTYTTRDELVAKEGVEEPSKKRVIEGKNSSAVEQDHAKTSAKTERASAQQENSSTCIGSAIKSESGNSARSSGISSQNSSTSDGDRSVSSQSSSSVSSQVTTAGSGKASEAEAPDKHGSASFVSLLKSSVNSHMTQSTDSRQQSGSPKKSALEGSSASASQSSSEIEVPLLGSSGSSEVELPLLSSKPSSETASSGLTSKTSSEASVSSSVAKNSSSSGTSLLTPKSSSSTNTSLLTSKSTSQVAASLLASKSSSQTSGSLVSKSTSLASVSQLASKSSSQTSTSQLPSKSTSQSSESSVKFSCKLTNEDVKQKQPFFNRLYKTVAWKLVAVGGFSPNVNHGELLNAAIEALKATLDVFFVPLKELADLPQNKSSQESIVCELRCKSVYLGTGCGKSKENAKAVASREALKLFLKKKVVVKICKRKYRGSEIEDLVLLDEESRPVNLPPALKHPQELL

SEQ ID NO: 1025339 - protein, 570 aa, Homo sapiens; identical to SEQ ID NO: 1025338

SEQ ID NO: 1025340 - protein, 580 aa, Homo sapiens
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGIKVTDAPTYTTRDELVAKVKKRGISSSNEGVEEPSKKRVIEGKNSSAVEQDHAKTSAKTERASAQQENSSTCIGSAIKSESGNSARSSGISSQNSSTSDGDRSVSSQSSSSVSSQVTTAGSGKASEAEAPDKHGSASFVSLLKSSVNSHMTQSTDSRQQSGSPKKSALEGSSASASQSSSEIEVPLLGSSGSSEVELPLLSSKPSSETASSGLTSKTSSEASVSSSVAKNSSSSGTSLLTPKSSSSTNTSLLTSKSTSQVAASLLASKSSSQTSGSLVSKSTSLASVSQLASKSSSQTSTSQLPSKSTSQSSESSVKFSCKLTNEDVKQKQPFFNRLYKTVAWKLVAVGGFSPNVNHGELLNAAIEALKATLDVFFVPLKELADLPQNKSSQESIVCELRCKSVYLGTGCGKSKENAKAVASREALKLFLKKKVVVKICKRKYRGSEIEDLVLLDEESRPVNLPPALKHPQELL

SEQ ID NO: 1025341 - protein, 570 aa, Homo sapiens; identical to SEQ ID NO: 1025338

SEQ ID NO: 1025342 - protein, 126 aa, Homo sapiens
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGIKVTDAPTYTTRDELVAKKG

SEQ ID NO: 1025343 - protein, 86 aa, Homo sapiens
HLPLTQEQKQMLGERLCPLIQAMHPTLAGKITGLWLTWIIQNFFICSSLQSHSVLRLMKLYAVLQAHQAKEAAQKAVNSATGVPTV

SEQ ID NO: 1025344 - protein, 86 aa, Homo sapiens; identical to SEQ ID NO: 1025343

SEQ ID NO: 1025345 - protein, 516 aa, Homo sapiens
LGARTSARLGDPAAPRRRLAPSPGPSVGILGPPRAPPPAAMASLGDLVRAWHLGAQAVDRGDWARALHLFSGVPAPPARLCFNAGCVHLLAGDPEAALRAFDQAVTKDTCMAVGFFQRGVANFQLARFQEALSDFWLALEQLRGHAAIDYTQLGLRFKLQAWEVLHNVASAQCQLGLWTEAASSLREAMSKWPEGSLNGLDSALDQVQRRGSLPPRQVPRGEVFRPHRWHLKHLEPVDFLGKAKVVASAIPDDQGWGVRPQQPQGPGANHDARSLIMDSPRAGTHQGPLDAETEVGADRCTSTAYQEQRPQVEQVGKQAPLSPGLPAMGGPGPGPCEDPAGAGGAGAGGSEPLVTVTVQCAFTVALRARRGADLSSLRALLGQALPHQAQLGQLSYLAPGEDGHWVPIPEEESLQRAWQDAAACPRGLQLQCRGAGGRPVLYQVVAQHSYSAQGPEDLGFRQGDTVDVLCEVDQAWLEGHCDGRIGIFPKCFVVPAGPRMSGAPGRLPRSQQGDQP

SEQ ID NO: 1025346 - protein, 172 aa, Homo sapiens
GNSGGPESPWWLRWSWAPPRLRQLLEEGLAEVTALPAGPTQEAPSEESLCSYLAPGEDGHWVPIPEEESLQRAWQDAAACPRGLQLQCRGAGGRPVLYQVVAQHSYSAQGPEDLGFRQGDTVDVLCEVDQAWLEGHCDGRIGIFPKCFVVPAGPRMSGAPGRLPRSQQGDQP

SEQ ID NO: 1025347 - protein, 523 aa, Homo sapiens
LGARTSARLGDPAAPRRRLAPSPGPSVGILGPPRAPPPAAMASLGDLVRAWHLGAQAVDRGDWARALHLFSGVPAPPARLCFNAGCVHLLAGDPEAALRAFDQAVTKDTCMAVGFFQRGVANFQLARFQEALSDFWLALEQLRGHAAIDYTQLGLRFKLQAWEVLHNVASAQCQLGLWTEAASSLREAMSKWPEGSLNGLDSALDQVQRRGSLPPRQVPRGEVFRPHRWHLKHLEPVDFLGKAKVVASAIPDDQGWGVRPQQPQGPGANHDARSLIMDSPRAGTHQGPLDAETEVGADRCTSTAYQEQRPQVEQVGKQAPLSPGLPAMGGPGPGPCEDPAGAGGAGAGGSEPLVTVTVQCAFTVALRARRGADLSSLRALLGQALPHQAQLGQLSYLAPGEDGHWVPIPEEESLQRAWQDAAACPRGLQLQCRGAGGRPVLYQVVAQHSYSAQGPEDLGFRQGDTVDVLCEEPDVPLAVDQAWLEGHCDGRIGIFPKCFVVPAGPRMSGAPGRLPRSQQGDQP

SEQ ID NO: 1025348 - protein, 584 aa, Homo sapiens
LGARTSARLGDPAAPRRRLAPSPGPSVGILGPPRAPPPAAMASLGDLVRAWHLGAQAVDRGDWARALHLFSGVPAPPARLCFNAGCVHLLAGDPEAALRAFDQAVTKDTCMAVGFFQRGVANFQLARFQEALSDFWLALEQLRGHAAIDYTQLGLRFKLQAWEVLHNVASAQCQLGLWTEAASSLREAMSKWPEGSLNGLDSALDQVQRRGSLPPRQVPRGEVFRPHRWHLKHLEPVDFLGKAKVVASAIPDDQGWGVRPQQPQGPGANHDARSLIMDSPRAGTHQGPLDAETEVGADRCTSTAYQEQRPQVEQVGKQAPLSPGLPAMGGPGPGPCEDPAGAGGAGAGGSEPLVTVTVQCAFTVALRARRGADLSSLRALLGQALPHQAQLGQLSYLAPGEDGHWVPIPEEESLQRAWQDAAACPRGLQLQCRGAGGRPVLYQVVAQHSYSAQGPEDLGFRQGDTVDVLCEGRVGMALPRQHRGARGVGGLELGLCCLADVAPKRPRLGNALQSPMSPLQWTRHGWRATVTAASASSPSASWSPPALGCQEPPAACPDPSREISPNDAVSMMLLIKTTPTAKKK

SEQ ID NO: 1025349 - protein, 136 aa, Homo sapiens
VVKRDSIATMSFSGKYQLQSQENFEAFMKAIGLPEELIQKGKDIKGVSEIVQNGKPLRLTITVGSKGIQTEFTVGKECNLKTLPGKKVRTGVKLEGAIKRGTTFKTIKFGTELNGTLYPIPMTLGEIAFKRFTRGF

SEQ ID NO: 1025350 - protein, 270 aa, Homo sapiens
AGRRCPDRSPPFGPDFGSSGVLMLLKPESTCPDPSLYDADSARSQNQSHAGVWPLTPRGRPRLRPHLATRTSQPRSRPEPPCAGTLLPLAGLYLVQGLPYGLQSGLLPVLLRAGGLSLTRVGLAKVLYAPWLLLAWAPLVDAQGSARAWVTRTRRAWAWCVGCIPGPPWSLARPGARRWRACLFVEPWGAANARNVAPGPRLACAACLEPGRTWGPGTLCVVAYAGGPRYLGGALLALLPTFSWPQLFLLLAAPTGWPRPGLGTSLRRLH

SEQ ID NO: 1025351 - protein, 101 aa, Homo sapiens
DELASTKQKLEKAENQVLAMRKQSEDLTKEYDRLLEEHAKLQAAVMMVPVDKKEEKGLLSSPACSVAFQPGHVPACFLRARSVSLQYFVFVPCLLPPFPFH

SEQ ID NO: 1025352 - protein, 104 aa, Homo sapiens
YQKCTLLHLADGQVKEPFKPSKKDSIACTYSNKNDVDLRSSNDKWKEKIKKEGDCRKESNSSSNQLDKSQKLPDVKPSPINLRKKSLTVKVDIEECTFEGSSRS

SEQ ID NO: 1025353 - protein, 504 aa, Homo sapiens
VRLAEDLRIQKKNTPSQLEEALKTLSTRSSFQKRYPEDRDYRKYGHTSQRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKNYTTQRKDIITHKPFEVEGNHRNTRVRPFKSNFRGGRCQPNYKSGLVQKSLYIQAKYQRLRFTGPRGFITHKFRERLMRKKKF

SEQ ID NO: 1025354 - protein, 533 aa, Homo sapiens
VRLAEDLRIQKKNTPSQLEEALKTLSTRSSFQKRYPEDRDYRKYGHTSQRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKVKNVHTDGFQKPTHFIKSNFRKCIEKPYMNYTTQRKDIITHKPFEVEGNHRNTRVRPFKSNFRGGRCQPNYKSGLVQKSLYIQAKYQRLRFTGPRGFITHKFRERLMRKKKF

SEQ ID NO: 1025355 - protein, 258 aa, Homo sapiens
VRLAEDLRIQKKNTPSQLEEALKTLSTRSSFQKRYPEDRDYRKYGHTSQRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDIEECTFEGSSRS

SEQ ID NO: 1025356 - protein, 505 aa, Homo sapiens
VRLAEDLRIQKKNTPSQLEEALKTLSTRSSFQKRYPEDRDYRKYGHTSQRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKNYTTQRKDIITHKPFEVEGNHRNTRVRPFKSNFRGGRCQPNYKSGLVQKSLYIQAKYQRLRFTGPRGFITHKFRERLMRKKKVP

SEQ ID NO: 1025357 - protein, 512 aa, Homo sapiens
VRLAEDLRIQKKNTPSQLEEALKTLSTRSSFQKRYPEDRDYRKYGHTSQRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKNYTTQRKDIITHKPFEVEGNHRNTRVRPFKSNFRGGRCQPNYKSGLVQKSLYIQAKYQRLRFTGPRGFITHKFRERLMRKKKEYTDVATGI

SEQ ID NO: 1025358 - protein, 505 aa, Homo sapiens
VRLAEDLRIQKKNTPSQLEEALKTLSTRSSFQKRYPEDRDYRKYGHTSQRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKNYTTQRKDIITHKPFEVEGNHRNTRVRPFKSNFRGGRCQPNYKSGLVQKSLYIQAKYQRLRFTGPRGFITHKFRERLMRKKKVS

SEQ ID NO: 1025359 - protein, 167 aa, Homo sapiens
MCFFLSNLCWADIGFTSATVPKMIVDMRSHSGVISYADCLTRMSFLVLFACVEDMLLTVMAYDCFVAICRPLHYPVIVNPHLCVFLVSVSFSLACWIPSCAVGLCCNSPSSRMWKSLILSVTHLNLSSLPVLTASSIACSYISIVLCLVFFPFQGSFCLTIKLSPPF

SEQ ID NO: 1025360 - protein, 167 aa, Homo sapiens; identical to SEQ ID NO: 1025359

SEQ ID NO: 1025361 - protein, 338 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 1025362 - protein, 246 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEANPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 1025363 - protein, 132 aa, Homo sapiens
RGASCRVVGVGCGVSQRPSGPTLERLLRASYLAPRRHDHNPPPSRESTPTAGIAPEFCGSRWWIQFFIRCDEPTEQPVRKNKMGSNIFGTPEENQASWASQQVPSLVVAGKTWSHLDCRRRNSSGSKAPETS

SEQ ID NO: 1025364 - protein, 183 aa, Homo sapiens
DLQPAVESTSIAQRVDTIDWPTVDAELDRYGCAHVPGLMPASECDALTSLYPRDALYRSRVVMARHGFGRGEYKYFAYPLPALIAELRETLYPHLAPIANRWNQALGIDVRYPKDHTTFLDRLHAAGQTRPTPLILQYGPDDYNCLHQDLYGEHVFPLQVAILLSAPGRDFTGGEFVLTEQRP

SEQ ID NO: 1025365 - protein, 159 aa, Homo sapiens
VDILRKCRLVAKEYLDENNPEESIGDLQFNLNISEIENNIVSLLERSDRKVVILMDKLDEAYEPDNIGIGIIAGLAYASIELNQKAKCIRPIIFLRDNIFRSLSKEDPDYSRNIEGQVIRLHWDWAQLLMLSAKRMKVAFKLDIEKDQRVWDRCTADDP

SEQ ID NO: 1025366 - protein, 126 aa, Homo sapiens
SASLRAPQAEGRPLCSLWRTFIYLSPEYDTCPWKELAEFKVAKLSPGEAGEMAWSSCWALSQLRAHWSPTPTSLPCFGPYLLRPRPTSGWGFWQGAGRYHLAAPREHPADSVLHGCNVAFFRFSSI

SEQ ID NO: 1025367 - protein, 82 aa, Homo sapiens
ECYEDSPDTVASLRMMGHRGSVVRMVPKGDAGRGGPKGEPGSPGGKWSNVSDRPRSQAQNLSPAISLPASKDSFFPPTSTPT

SEQ ID NO: 1025368 - protein, 102 aa, Homo sapiens
MILSCARQAVYEQTMKLFAELEKLKGKREKPNEMHERKRQREEEIEAQEKAKREREWQKNFEESRDGRVDSWRNFQANTKGKKEKKNRTFLRPPKVKMEQRE

SEQ ID NO: 1025369 - protein, 90 aa, Homo sapiens
MHQLQGNKEYGSEKKGYLLKKSDGIRKVWQRRKCSVKNGILTISHATVSMFLNLPCLMGQKANTIMYSAVKIGANIFMHLGQIILDIPLP

SEQ ID NO: 1025370 - protein, 163 aa, Homo sapiens
HTLGYKDTPWCSPIKVKYGDVYCRAPQGGYYKTALGTSCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPKNQVPKLLKERIFRNPNKLDSPGVLGDTE

SEQ ID NO: 1025371 - protein, 113 aa, Homo sapiens
MQNSISTSAVNRWNRDAPFPGRGRFSRTRGDGKRARTEAPSGSAAEKPLPGAAADGRLKLRLWRGASPVSDPPDTPGGGGDADAEQGERVATEAAAEVQSLPNASGRRRLAAR

SEQ ID NO: 1025372 - protein, 113 aa, Homo sapiens; identical to SEQ ID NO: 1025371

SEQ ID NO: 1025373 - protein, 113 aa, Homo sapiens; identical to SEQ ID NO: 1025371

SEQ ID NO: 1025374 - protein, 113 aa, Homo sapiens; identical to SEQ ID NO: 1025371

SEQ ID NO: 1025375 - protein, 228 aa, Homo sapiens
MGNGASRTPRALRAWGSPTRGFCEPGSEGRPRAPAQRGCAAERISQSATARGDFAYADPAPPVGRSPTLRLLGVLHTREKARKTGTRSTTACVSLHGWESLGQLKRAKWPKCACDNRVPGESVVGLGPGTPGARGGLGTPSCGSSTSPARAPGVFRVAGADARHPGALPGAPGAGALACTPSGLMLDELLASPEFLQQAQHFLETEAPGELEALEDAASLEAPLSEEE

SEQ ID NO: 1025376 - protein, 170 aa, Homo sapiens
VTSILLSVSELAYSRISHPITQGGAITDSLDHCMARPPSLEQFSCLRPSEIAGTTSVVLDRVVESEETIRQAKRLVAMASDLDFSPPEVPEPTFLENLLRYGLFLGAIFQLICVLAIIVPISKSHEGGGLNRFEAQKLLRLPREAQGCCSFCEQRGQRKRLRQKRSNEEA

SEQ ID NO: 1025377 - protein, 105 aa, Homo sapiens
RSKNYGEWGRLCPKSRKNLFPEPQGWPPCPPLAPPFIGSIHPPEPAQSKPVPASQDGQSRPSPPTSTGALKGPRSPKVGAGALTLRPWCGGKSEGLGDRQLGGAL

SEQ ID NO: 1025378 - protein, 127 aa, Homo sapiens
EDLENLVVSAVPSPPVLPRDWRVHLPGLWGQICGDLSLHPLLLWLPSLKYRTPGWAEPSQSATAQEGELVPALTGQALEGRDNHGRPAQIPRPGLGHRKKQHFLKGKRLPDRSLGFEAEAAVTVSPY

SEQ ID NO: 1025379 - protein, 105 aa, Homo sapiens
PLTTPSRGKNLKDDFNLGKPKSSGRSIVTTSMTQATELQAESGLLRRFKVSDEVKLPRAFCSRPPRLQQHPGREEASGVCLRAHLWFCRSPSARPRQHRTVCEAQ

SEQ ID NO: 1025380 - protein, 100 aa, Homo sapiens
EFRGRGKAQGLGNLDGRSGEACGGGEWGWVGVTQPTGEGVHAPIRGPRKPWGGLGMEGVGVGLLPWGPTPHFCTRHLRGHGWCLKTPRCEGTTKNLWPTL

SEQ ID NO: 1025381 - protein, 142 aa, Homo sapiens; identical to SEQ ID NO: 760521

SEQ ID NO: 1025382 - protein, 334 aa, Homo sapiens
MPKRRDILAIVLIVLPWTLLITVWHQSTLAPLLAVHKDEGSDPRRETPPGADPREYCTSDRDIVEVVRTEYVYTRPPPWSDTLPTIHVVTPTYSRPVQKAELTRMANTLLHVPNLHWLVVEDAPRRTPLTARLLRDTGLNYTHLHVETPRNYKLRGDARDPRIPRGTMQRNLALRWLRETFPRNSSQPGVVYFADDDNTYSLELFEEMRSTRRVSVWPVAFVGGLRYEAPRVNGAGKVVRWKTVFDPHRPFAIDMAGFAVNLRLILQRSQAYFKLRGVKGGYQESSLLRELVTLNDLEPKAANCTKILVWHTRTEKPVLVNEGKKGFTDPSVEI

SEQ ID NO: 1025383 - protein, 132 aa, Homo sapiens
FPPLHARRGFGIISQSTQLALKLSVVLLAPGPSVLTAARQTPAAKMVKQIESKTAFQEALDAAGDKLEVVDFSPTWCGPCKLLKPFFHSLSEKDFNGIFLEVDVDDCHDVASECEVCMPTFQYCKNGPKEPE

SEQ ID NO: 1025384 - protein, 65 aa, Homo sapiens
MVRKPGRQLQEGAEEKERRASKAAGGRAQWLTPGIPALWEAEAGGSRGQEIETILANTVKPPSLL

SEQ ID NO: 1025385 - protein, 68 aa, Homo sapiens
MEPAREQGGSLEHKLYLCPSELLGNMMRPHGNGILHITQAVLGVRQTGLSRAVCMQQLVHCSGPVDHF

SEQ ID NO: 1025386 - protein, 68 aa, Homo sapiens; identical to SEQ ID NO: 1025385

SEQ ID NO: 1025387 - protein, 181 aa, Homo sapiens
MNPRKKVDLKLIIVGAIGVGKTSLLHQYVHKTFYEEYQTTLGASILSKIIILGDTTLKLQIWDTGGQERFRSMVSTFYKGSDGCILAFDVTDLESFEALDIWRGDVLAKIVPMEQSYPMVLLGNKIDLADRKVPQEVAQGLVVEEKDIPYFEVSAKNDINGGAKRLRCWPHKGSDGGTRAS

SEQ ID NO: 1025388 - protein, 68 aa, Homo sapiens; identical to SEQ ID NO: 1025385

SEQ ID NO: 1025389 - protein, 68 aa, Homo sapiens; identical to SEQ ID NO: 1025385

SEQ ID NO: 1025390 - protein, 134 aa, Homo sapiens
EFPFENRTLILTPVYTRNETGPYECEIRDRDVGMNSDPVTLNVLYGPDLPSIYPSFTYYRSGENLYLILFAESNPPEEYFWTINGKFQKSGQKLSIPQITTKHRGLYTRSVRHSATGKESSKSITVASLCSFRI

SEQ ID NO: 1025391 - protein, 229 aa, Homo sapiens
ELGPSMAPEEHYRRLVSALSEASTFEDPQRLYHLGLPSHGEDPPWHDPPHHLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFARQQELLRKQNLARLELPDDSCGRRSWRARAHSCWRPRPPAPQRRRRGAAAARGLLVLNHGAEPLLAL

SEQ ID NO: 1025392 - protein, 239 aa, Homo sapiens
GQQGTNPYLTLHCVNQGTILLDLAPEDKEYQSVEEEMQSTIREHRDGGNAGGIFNRYNVIRIQKVVNKKLRERFCHRQKEVSEENHNHHNERMLFHGSPFINAIIHKGFDERHAYIGGMFGAGIYFAENSSKSNQYVYGIGGGTGCPTHKDRSCYICHRQMLFCRVTLGKSFLQFSTMKMGPRASRAPLQSLVDRASMGWHMLEYVHLTEENRLTQSIIFTRSLKARSPFPRTATAAEQ

SEQ ID NO: 1025393 - protein, 89 aa, Homo sapiens
SCSQGGNRGRRLCCRIREAQRRHLHFTLSASEDAIRKQPRHSLFMDAHFQFNRGIPGARAPSKLCFTNSLRVWNYLPSSHDGPLSSRPS

SEQ ID NO: 1025394 - protein, 148 aa, Homo sapiens
GKNRLIFPVREGALGVVWVVPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDMLPPDSSHVLEVHAEVCPGAELKGRNSHSPR

SEQ ID NO: 1025395 - protein, 582 aa, Homo sapiens [sequence omitted]

SEQ ID NO: 1025396 - protein, 108 aa, Homo sapiens
SCRIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 1025397 - protein, 108 aa, Homo sapiens; identical to SEQ ID NO: 1025396

SEQ ID NO: 1025398 - protein, 108 aa, Homo sapiens; identical to SEQ ID NO: 1025396

SEQ ID NO: 1025399 - protein, 106 aa, Homo sapiens
MVSNTWGSGLLAEHARGLRFSGWSYGNEYGTAKLHSSPDDPTPYSIKTWTPNAFIFAKPSPPPSHDDARRTPYPPWNDYVSTEPHNVKFCRSQCWRTGYGHSCPIV

SEQ ID NO: 1025400 - protein, 110 aa, Homo sapiens
MFRNLTRFLFPSLFSGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 1025401 - protein, 205 aa, Homo sapiens
LAHVADRVDTFKAFSKKMDDSVLQLSTVASELVRKHVGGFRKEFQKLGSAFQANQSFLPDWTPPFALRPYNSAISHTGRTYEAIGEMFAEQPKNDLFQMLDTLSLYQGLLSNFPDIIHLQKGAFAKVKESQRMSDEGRMVQDEADGIRRRCRVVGFALQAEMNHFHQRRELDFKHMMQNYLRQQILFYQRVGQQLEKTLRMYDNL

SEQ ID NO: 1025402 - protein, 205 aa, Homo sapiens; identical to SEQ ID NO: 1025401

SEQ ID NO: 1025403 - protein, 904 aa, Homo sapiens
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLADLYEEAAENLHQLSDKLPAPGRAMVDIILLLSDKDPPKLKDYLPTVGALKHLREWYSAKITIAGNHCEINCQKIAEYLSANVVSLEDLRNVIDSKELWRGKIQIWERKFGFEISFPEFCLKGVTLKNFSTSNLNTDFLAKKIIPSKDKNILPKVFHYYGPALEFVQMIKLSDLPSCYMSDIEFELGLTNSTKQNSVLLLEQISSLCSKVGALFVLPCTISNILIPPPNQLSSRKWKEYIAKKPKTISVPDVEVKGECSSYYLLLQGNGNRRCKATLIHSANQINGSFALNLIHGKMKTKTEEAKLSFPFDLLSLPHFSGEQIVQREKQLANVQVLALEECLKRRKLAKQPETVSVAELKSLLVLTRKHFLDYFDAVIPKMILRKMDKIKTFNILNDFSPVEPNSSSLMETNPLEWPERHVLQNLETFEKTKQKMRTGSLPHSSEQLLGHKEGPRDSITLLDAKELLKYFTSDGLPIGDLQPLPIQKGEKTFVLTPELSPGKLQVLPFEKASVCHYHGIEYCLDDRKALERDGGFSELQSRLIRYETQTTCTRESFPVPTVLSPLPSPVVSSDPGSVPDGEVLQNELRTEVSRLKRRSKDLNCLYPRKRLVKSESSESLLSQTTGNSNHYHHHVTSRKPQTERSLPVTCPLVPIPSCETPKLATKTSSGQKSMHESKTSRQIKESRSQKHTRILKEVVTETLKKHSITETHECFTACSQRLFEISKFYLKDLKTSRGLFEEMKKTANNNAVQVIDWVLEKTSKK

SEQ ID NO: 1025404 - protein, 904 aa, Homo sapiens; identical to SEQ ID NO: 1025403

SEQ ID NO: 1025405 - protein, 271 aa, Homo sapiens
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLADLYEEAAENLHQLSDKLPAPGRAMVDIILLLSDKDPPKLKDYLPTVGALKHLREWYSAKITIAGNHCEINCQKIAEYLSANVVSLEDLRNVIDSKELWRGKIQIWERKVNGLFTVCQVGLSILFTTQIFK

SEQ ID NO: 1025406 - protein, 163 aa, Homo sapiens
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLAEYAYMVFVLSLKYLILDSYFNP

SEQ ID NO: 1025407 - protein, 196 aa, Homo sapiens
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLADLYEEAAENLHQLSDKLPAPGRAMVDIILLLSDKDPPKLKDYLPTVGALKEIPKC

SEQ ID NO: 1025408 - protein, 202 aa, Homo sapiens
SLTRVIYGIMVPSLRLGKIPMKKIRATNCFGDNDPIDVCEIGSKILSCGEVIHVKILGILALIDEGETDWKLIAINANDPEASKFHDIDDVKKSNRGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 1025409 - protein, 146 aa, Homo sapiens
PWILGLETRTPFNCQTFPAKNLGFPRKRKEPKMLANSRKIDWNAKLEGSQLRDYCAPPTLIRLLKCKRDSFPNFLACKQERHDWDYCEHRDYVMRMKEFERERRLLQRKKRREKKAARCLQRPGTRGSGPQGGPVRVHPPPYGPVK

SEQ ID NO: 1025410 - protein, 97 aa, Homo sapiens
RLSFIEAHGLKASSCRKPKIQIFNERPGKDPEKPEASMEVKGQKLIITRVLTEKTTEADLVFENGRYLAGLVYNMWKQDLLDWAITRDYSGGLVELI

SEQ ID NO: 1025411 - protein, 118 aa, Homo sapiens
MGTRILPDLCFVLLGLGIEVHGTQQAQQDEMPRPSFLTQVKESLSRYWESAKTRRHNLYEKTYLSAVDEKLKDLCTESTGAMSTYTGVFTGQGLSVLKGEEYQADPPSEGKGERALLP

SEQ ID NO: 1025412 - protein, 279 aa, Homo sapiens
GAQSAGMTGVSPVPGLVISLAVPNLPLIPSILSPTWSFLSPPSLPPDVVLSLTTQPTARRGPFPHHPAYRPTWSFPSPPSLPPDVVLSLTTQPAVGASVHGGLSESAFVLLSKTLGYEYERPQFFKEYYCLVVFISLRVSLGMGEHKTLPIRCRDYVTQQSSTNYTYFTMWKFCLEGEDGGLDSVLLQIVDVQDGLQIYGLHLANGSDLRPEVARLDFVRALESFPNVAWELQGMSCSTLEPPALQYYGIVLAKTIADFTPAIYAKANGSSESSLETIN

SEQ ID NO: 1025413 - protein, 265 aa, Homo sapiens
PTLERSPSPPSLPSDVSLSLTTHPTARRGHFSHHPAYRPTWSFPSPPSLPPDVVLSLTTQPTARRGPFRSPPSLPPDVVLSLTTQPAVGASVHGGLSESAFVLLSKTLGYEYERPQFYQRVLLSRGIHFSFVSLSVWASTKHYPSDVETMLPSSRPRNTAYFTIVEIPSSSASTEVSTLYCSRSWTCKIGLQIVWAPSDEGSDLRPEVARLDFVRALESFPNVAWELQGMSCSTLEPPALQYYGIVLAKTIADFTPAIYAKEWVL

SEQ ID NO: 1025414 - protein, 110 aa, Homo sapiens
FALLQAQLRGTDAARCRTSRLGRGSLCRRAEFRDAFTQELRAAAELAASHQVARGALAQTFNPGLCGAEALAFPSGLYSGINVEGSFRALRAASNPDWDCWPADIPRIRA

SEQ ID NO: 1025415 - protein, 103 aa, Homo sapiens
IVLFRLGDKKCNSVSTKRKKAKTSTFFHHPNIPPVLLSNPSSSWNPNLGTTHAFSVLGVLPFPECHGIITVCSGSCLASPARHDAPEIRVVVRVSRLLLFAAV

SEQ ID NO: 1025416 - protein, 141 aa, Homo sapiens
VENLLNGNETNFNNRNSYEHELRNLNTTQLIGKFGPQKAKVVLTAIVIASHHRLRDRACLAQRHDNRTDHVDGTTWHAERDEQRRGRGMMSFVDHLPVLPVLLPALTAWLLLLIGDHGADAHGGHGHLKLLWGAPQALPFS

SEQ ID NO: 1025417 - protein, 181 aa, Homo sapiens
MESTEDLILDDFKGKYWCFSCISFGFHHVSVLTEIVLLVTNANVLSDVNCEACRSSQMDSQVYTILTGKYTKKEWWYGPFMNIVLLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 1025418 - protein, 130 aa, Homo sapiens
SDSIRYLMILSNKALEMSQNLKHEPKLQLKGYLLKNKKENKNNQNQVLEDTVTNAVCVCRIQVGPKVKLLAETGLPLLQTLLVTLAGAVSQWQMLSSPLSPEREIGGKACHTQRGRPKGSILSCVATTSW

SEQ ID NO: 1025419 - protein, 120 aa, Homo sapiens
WICWCSTTRLNRDMRKLQLKGYLLKNKKENKNNQNQVLEDTVTNAVCVCRIQVGPKVKLLAETGLPLLQTLLVTLAGAVSQWQMLSSPLSPEREIGGKACHTQRGRPKGSILSCVATTSW

SEQ ID NO: 1025420 - protein, 198 aa, Homo sapiens
FPLTRHPLGLGNKDRAGRIHKSRRSRPSRPNTGETRSPGVLAAPCSPSHSGEQGQENRLNLGVGVCPEIVPLHSSLAGLLGTVEVPGAPRVPSTRQTGIPGGLSAPLGFQTGAGRSGSRSRSWYSGGLADVAADRAGDAAGPGLCLRDLQKVSPRGRPRASLVSSVTLLLSSQKVVWEAGKAGLEECLVTEVQVVQKT

SEQ ID NO: 1025421 - protein, 407 aa, Homo sapiens
FVCMIPFIPYVQIQANPQRQKVDEWLPQAGEEEGRVFNGSGVSFWGRDNVHRFPSRSSSFCCEHQALEGASVLHYPQPSFTASPRCLTLLAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 1025422 - protein, 327 aa, Homo sapiens [sequence omitted]

SEQ ID NO: 1025423 - protein, 300 aa, Homo sapiens
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 1025424 - protein, 284 aa, Homo sapiens
MFVNPGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 1025425 - protein, 378 aa, Homo sapiens
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 1025426 - protein, 243 aa, Homo sapiens
MVNPPTTTNTGASLKGGALPQQGRVTSQHLFFHFACVLASLQVMMTLTNWYTARVDPKMISTWPAVWVKDLCQLGRAAPLPVDPGSPTPPAQPRLQLRQPHSLPSGASCHLVPLGSVKANPGPSPQPISQGSPPTPAPAPGPAPEPGLLVVVPSGSEEHQAPAEPHPPRHTHTVELPLPSPPPCCPYSASRMKGLPCPQAPRERGCWRERGTPTTVGHPALKPWCSWSRPPGDPAPFLDFVPY

SEQ ID NO: 1025427 - protein, 192 aa, Homo sapiens
MVNPPTTTNTGASLKGGALPQQGRVTSQHLFFHFACVLASLQVMMTLTNWYTARVDPKMISTWPAVWVKDLCQLGRAAPLPVDPGSPTPPAQPRLQLRQPHSLPSGASCHLVPLGSVKANPAASSFPSSLLPILSISDERAPLSSGSTGAGLLERAGNSHHSGASGTEALVFLVTSPRGPCPLPGLRALLSL

SEQ ID NO: 1025428 - protein, 185 aa, Homo sapiens
MVNPPTTTNTGASLKGGALPQQGRVTSQHLFFHFACVLASLQVMMTLTNWYTARVDPEDDQHVARRVGERSVPAGQGCSFTCGPAPEPGLLVVVPSGSEEHQAPAEPHPPRHTHTVELPLPSPPPCCPYSASRMKGLPCPQAPRERGCWRERGTPTTVGHPALKPWCSWSRPPGDPAPFLDFVPY

SEQ ID NO: 1025429 - protein, 31 aa, Homo sapiens
MCHHARLIFVFLVETGFHHVGQAGLEFLTSS

SEQ ID NO: 1025430 - protein, 116 aa, Homo sapiens
MSTEKVCYPRFLSAEAIGIMRRLLRRNPERRLGSSERDAEDVKKQPFFRTLGWEALLARGLPPPFVPTLSGRTDVSNFDEEFTGEAPTLSPPRDGRPLTAAEQAAFLDFDFVAGGC

SEQ ID NO: 1025431 - protein, 190 aa, Homo sapiens
DPRLSFTRQSFVDRSLLTLLGHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPM

SEQ ID NO: 1025432 - protein, 171 aa, Homo sapiens
FLTVKILSVYRILSIKFDIFYKIYFMFNKTKDNYFTFLKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLSNPDAAGW

SEQ ID NO: 1025433 - protein, 51 aa, Homo sapiens
MAGRKPRRCAHTFARRATRTVAGQGMRRSASGALPRDEKTSGWFLDRERKR

SEQ ID NO: 1025434 - protein, 458 aa, Homo sapiens
MALKVATVAGSAERVLLGPALLCRPWEVLGAHEVPSRNIFSEQTIPPSAKYGGRHTVTMIPGDGIGPELMLHCSSSVFRHACVPVDFEEVHVSSNADEEDIRNAIMAIRRNRVAELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVGEALKDHHQMAKSLRSWQSMPFQLAQEELGAEKVTAVAQGPHHVCPLTSLRAVQKQLQWPAWACSEGFGGPKAQLATRGAHRQASAPVALVGLAENPHLGEVGWDSVHFAGEGQVRIQTPETPWGPSVTPLSRPADCYLMGKLVSYSSAPNRKLGDGLLLQCCKEGGGAASLRYTFENMTVDSNTMQVLRLSSAVTPDLSALGFSQPCFRICSSARPLLVRSWCP

SEQ ID NO: 1025435 - protein, 318 aa, Homo sapiens
MRQISGVESNLEQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNL

SEQ ID NO: 1025436 - protein, 89 aa, Homo sapiens
AGRGGRNMAQALSEEEFQRMQAQLLELRTNNYQLSDELRKNGVELTSLRQKVAYLDKEFSKAQKVPPSTHPSTYPSTLASTYLTHSSLQ

SEQ ID NO: 1025437 - protein, 135 aa, Homo sapiens
AGRGGRNMAQALSEEEFQRMQAQLLELRTNNYQLSDELRKNGVGEPGGPYYKGVALGNGVRGFPSEAWQEGLSVSCHWLRLSFPAFPTPELTSLRQKVAYLDKEFSKAQKVPPSTHPSTYPSTLASTYLTHSSLQ

SEQ ID NO: 1025438 - protein, 219 aa, Homo sapiens
AGRGGRNMAQALSEEEFQRMQAQLLELRTNNYQLSDELRKNGVELTSLRQKVAYLDKEFSKAQKALSKSKKAQEVEVLLSENEMLQAKLHSQEEDFRLQNSTLMAEFSKERYGKEAGKFSAVSEGQGDPPGGPAPTVLAPMPLAEVELKWEMEKEEKRLLWEQLQGLESSKQAETSRLQEELAKLSEKLKKKPESLAVCRQKRRLCLMTAGTRLRNYNR

SEQ ID NO: 1025439 - protein, 133 aa, Homo sapiens
MAQALSEEEFQRMQAQLLELRTNNYQLSDELRKNGVGEPGGPYYKGVALGNGVRGFPSEAWQEGLSVSCHWLRLSFPAFPTPELTSLRQKVAYLDKEFSKAQKALSKSKKAQVRGSLVGECDWEMSWWAISVC

SEQ ID NO: 1025440 - protein, 272 aa, Homo sapiens
AGRGGRNMAQALSEEEFQRMQAQLLELRTNNYQLSDELRKNGVELTSLRQKVAYLDKEFSKAQKALSKSKKAQEVEVLLSENEMLQAKLHSQEEDFRLQNSTLMAEFSKLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKPESLAVCRQKRRLCLMTAGTRLRNYNR

SEQ ID NO: 1025441 - protein, 198 aa, Homo sapiens
MGIKRIVKYMDKCYVGFSKYCSDSLLLCPFSSSVQLCSQMEQLEQENQQLKEGAAGAGVAQAGPLVDGELLRLQAENTALQKNVAALQERYGKEAGKFSAVSEGQGDPPGGPAPTVLAPMPLAEVELKWEMEKEEKRLLWEQLQGLESSKQAETSRLQEELAKLSEKLKKKPESLAVCRQKRRLCLMTAGTRLRNYNR

SEQ ID NO: 1025442 - protein, 122 aa, Homo sapiens
MTLSICVGGPFAPRHALKDFEGLRYNLVLSCEPRAKLLAARPVFCASGFGFHIPNRTQNPKRQLEEQWRVVAKIMDLGQTAWVHITAPLTNSVTFGRFLNLSVPSSSSVKWGLYSIYLLRLC

SEQ ID NO: 1025443 - protein, 320 aa, Homo sapiens
FFFSRAIFYFLKVLKVIHLSKDDGCPSSQTISFSLSANPAAPKGLTLSEVVTSEPGPPHPTGWDVARLLQRPGGMVAWTSLWGQESVSMWAVTVDGGSKGRVLGRLWDGHNLVYGEITLFHQVSSNVSGLSHRNHFLGKFSEGTQIWKYHWITAGIVQRLEPSPSWINGWDTQTWSRKALVLHHQKRRDTQGGDKAQGLAFYSKAQKSPRPEYGCWEPPRVNDTGWVGTIKPGKTKKSTSQCVHEKWLPRRNGEGGLRGRAGNECNTQTKGWKKRGPRGKQWVRGERRLHPPLHDFGTARGRREHNETTGMTTRRIENEN

SEQ ID NO: 1025444 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 1025445 - protein, 360 aa, Homo sapiens; identical to SEQ ID NO: 1025444

SEQ ID NO: 1025446 - protein, 360 aa, Homo sapiens; identical to SEQ ID NO: 1025444

SEQ ID NO: 1025447 - protein, 360 aa, Homo sapiens; identical to SEQ ID NO: 1025444

SEQ ID NO: 1025448 - protein, 360 aa, Homo sapiens; identical to SEQ ID NO: 1025444

SEQ ID NO: 1025449 - protein, 360 aa, Homo sapiens; identical to SEQ ID NO: 1025444

SEQ ID NO: 1025450 - protein, 149 aa, Homo sapiens
MLFSALLLEVIWILAADGGQHWTYEGPHGQDHWPASYPECGTQCPGLPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLS

SEQ ID NO: 1025451 - protein, 93 aa, Homo sapiens
GPALSLRAANRSDLDEREASCEKFANGIVHDVDVLGAGIRLVTLLVDRDGLYKMNRLYLTPDGFFFRVHMLALDFSCNKPCPEFKPGIETDLE

SEQ ID NO: 1025452 - protein, 109 aa, Homo sapiens
HESTGLRTAEEPDAAGALTFACRFGATGRDRPLLGAGSGGWNRPFPLGLVREGAGPILQAAACLRRSTGRHWLWWEPVMKLVFLGRKEDHAAANFLPVSPSRPNRNFAG

SEQ ID NO: 1025453 - protein, 221 aa, Homo sapiens
GTRHLECEIQLLKNLLHERIVQYYGCLRDPQEKTLSIFMEYMPGGSIKDQLKAYGALTENVTRKYTRQILEGVHYLHSNMIVHRDIKGANILRDSTGNVKLGDFGASKRLQTICLSGTGMKSVTGTPYWMSPEVISGEGYGRKADIWSVACTVVEMLTEKPPWAEFEAMAAIFKIATQPTNPKLPPHVSDYTRDFLKRIFVEAKLRPSADELLRHMFVHYH

SEQ ID NO: 1025454 - protein, 221 aa, Homo sapiens; identical to SEQ ID NO: 1025453

SEQ ID NO: 1025455 - protein, 112 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVEVRIKNNYCLYL

SEQ ID NO: 1025456 - protein, 223 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVGEYFSIFK

SEQ ID NO: 1025457 - protein, 400 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRAPCLNGSSFFIYSPSISANLYVQEANRLLADLKSLALSWHTTQRNTISTQQHTSSSTLHNGTTQLIPN

SEQ ID NO: 1025458 - protein, 381 aa, Homo sapiens
MRSYQPESGKQFQNVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRAPCLNGSSFFIYSPSISANLYVQEANRLLADLKSLALSWHTTQRNTISTQQHTSSSTLHNGTTQLIPN

SEQ ID NO: 1025459 - protein, 123 aa, Homo sapiens
MKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEVSPDPKKKKRKKRNQVLK

SEQ ID NO: 1025460 - protein, 204 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLKTTEEHRLDILKGKIGIS

SEQ ID NO: 1025461 - protein, 468 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRDIEISTEEEKDTGDLKDSSLLKTKGNHRKNHKRDINAEKKYTIKSVIKSDGGFDTSFSVQKLLLLKKDSQLIRGGLDAVGPKLGEDGKRREGAPEYVRPSLVVGYKSLCGNRFAPHLCRKLITQGKNKLAMGGATH

SEQ ID NO: 1025462 - protein, 202 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEVSPDPKKKKRKKRNQVLK

SEQ ID NO: 1025463 - protein, 389 aa, Homo sapiens
MEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLNNPPEEAPRKPGIFPKTVKNKPIPALRVVEEKKKKKKKKGRMKKEDNIQAKEENMDTSNTSISKMKRSRPTSEGSDIESTEPQKQCSKKKKKRDRVEASSLPEVRTGKRKRSSSEDAESLAPRSKVKKIIQKDIIKEASEASKENRAPCLNGSSFFIYSPSISANLYVQEANRLLADLKSLALSWHTTQRNTISTQQHTSSSTLHNGTTQLIPN

SEQ ID NO: 1025464 - protein, 123 aa, Homo sapiens; identical to SEQ ID NO: 1025459

SEQ ID NO: 1025465 - protein, 224 aa, Homo sapiens
METESGNQEKVMEEESTEKKKEVEKKKRSRVKQVLADIAKQVDFWFGDANLHKDRFLREQIEKSRDGYVDISLLVSFNKMKKLTTDGKLIARALRSSAVVELDLEGTRIRRKKPLGERPKDEDERTVYVELLPKNVNHSWIERVFGKCGNVVYISIPHYKSTGDPKGFAFVEFETKEQAAKAIEFLHPTERQIPDILTGNSISRVEKKERSMKSIQQRTARHVV

SEQ ID NO: 1025466 - protein, 400 aa, Homo sapiens; identical to SEQ ID NO: 1025457

SEQ ID NO: 1025467 - protein, 157 aa, Homo sapiens
MRKKVFAAHVGGSGPSASYWLMWSEPAHPLTESSVYLRLTESVPSFCVAWKQTVRLLTSDRVSHWSAFPEARPSVSGSPAQAGSADGVRVHSGQCDSAVLGCSAKRPPDVGRWRVSSVESWPSASAAGKSAIATAGTRTGCVPALPHPSTGLRGRPH

SEQ ID NO: 1025468 - protein, 1023 aa, Homo sapiens
MTIATCAKCKSVHKISLQDLQKGTGKDGMYVCFQCSLGAAPPNFHFVSNNPSATHVGNKTENFSSSVNSKFKVRNFKPGKYYCDKCRFSTKDPLQYKKHTLQHEEIKFICSHCSYISYTKGEFQRHLVKHTGIFPYQCEYCDYGAIRNDYIVKHTKRVHERAGAKRPVKAVAKLEPKRTGTSKQNPELLKASNPRTTFQNKWSDQLSGFSLHANKDKMHNIMLLPEPKEYQKDVVCIPNKMTLSEPNEVNLFENKNVEVEVLSPAKEPVQPGMPLTVVAPAELVVPANCLAQLIDVKVVNGTQQLVLKLFPLEENNCLEAGRDNGGNSERMVKEKGSNEQEKVLSAEKTKSLTVDGNVGKLVGIDSFQPSVQKQLKNVKWVRSYDFIMPNSSVHNNGKSFINSETIEDFQKKNNLYPHRTAFPSVALKGHSLASVFKNSVLRSLGAASNPFPYKAAVCFAESGRNLHSNSQQLLPFAASPATCSFSGEKGLLPVSENDLESTSKVNIPVKVVSSNRKQEDNQTEEHKAVSTVGQISSQHKSEYLHINITGEDRSQQPGDKPLELKNSERTNNTNDGPVISSVFSLSSGSENVPEGIKWNSSTSKIKSIELLRRKIAQLIESCGKPSSLASNSAHRRSVGQASKGTSKATSEGIQEINVSLTGLGHSTGTLQKPPNDGGITGNRQLTHQQIYPHFADGSNRKTKSRVVQEAHVATPVLIPKGAVLRVLNSSENAHIIEATCEAPVSIPCSERQLIKPIPFCPVRQADSDLQPLRSERGPIDMSPNIETPLRPKLRKESAVCSTIHRKTGLLYGQQGSSELNKQGRLLSRSLSISRNKTKQVHLSRKKNKIQAEPSRCLKDPSIFQVARQLRLIAAKPDQLIKCPRRNQPVIVLNHPDVDSPEVTNVMKVINKYKGNVLKVVLSERTRCQLGIRRHHVRLTYQNAEEASQIKRQMMLKMKLKNVSPLNQRNYQVVDSLPDDSSQCVFKCWSCGRLYEDQEEWMSHGQRHLIEATRDWDVLSSKGK

SEQ ID NO: 1025469 - protein, 1023 aa, Homo sapiens; identical to SEQ ID NO: 1025468

SEQ ID NO: 1025470 - protein, 160 aa, Homo sapiens
MEEGSSSPVSPVDSLGTSEEELERQPKRFGRKRRYSKKSSEDGSPTPGKRGKKGSPSAQSFEELQSQRILANVRERQRTQSLNEAFAALRKIIPTLPSDKLSKIQTLKLAARYIDFLYQVLQSDEMDNKMTSCSYVAHERLSYAFSVWRMEGAWSMSASH

SEQ ID NO: 1025471 - protein, 160 aa, Homo sapiens; identical to SEQ ID NO: 1025470

SEQ ID NO: 1025472 - protein, 94 aa, Homo sapiens
SAVDSSRQRLTHFSAFSSLETQPSAARNPTAPSGLHGANVPSLSCPQAACSEGLTHSQTAFMAALSTGQGEAPGWLSVASAAQVELGCIRVCNF

SEQ ID NO: 1025473 - protein, 507 aa, Homo sapiens
MEEPAAPSEAHEAAGAQAGAEAAREGVSGPDLPVCEPSGESAAPDSALPHAARGWAPFPVAPVPAHLRRGGLRPAPASGGGAWPSPLPSRSSGIWTKQIICRYYIHGQCKEGENCRYSHDLSGRKMATEGGVSPPGASAGGGPSTAAHIEPPTQEVAEAPPAASSLSLPVIGSAAERGFFEAERDNADRGAAGGAGVESWADAIEFVPGQPYRGRWVASAPEAPLQSSETERKQMAVGSGLRFCYYASRGVCFRGESCMYLHGDICDMCGLQTLHPMDAAQREEHMRACIEAHEKDMELSFAVQRGMDKVCGICMEVVYEKANPNDRRFGILSNCNHSFCIRCIRRWRSARQFENRIVKSCPQCRVTSELVIPSEFWVEEEEEKQKLIQQYKEAMSNKACRYFAEGRGNCPFGDTCFYKHEYPEGWGDEPPGPGGGSFSAYWHQLVEPVRMGEGNMLYKSIKKELVVLRLASLLFKRFLSLRDELPFSEDQWDLLHYELEEYFNLIL

SEQ ID NO: 1025474 - protein, 105 aa, Homo sapiens
MEEPAAPSEAHEAAGAQAGAEAAREGVSGPDLPVCEPSGESAAPDSALPHAARGWAPFPVAPVPAHLRRGGLRPAPASGGGAWPSPLPSRSSGIWTKQIICRDIC

SEQ ID NO: 1025475 - protein, 192 aa, Homo sapiens
MGSELETAMETLINVFHAHFGANEGGQIIKARVNEVIADRELLPDWSLIMAFPGIVTRSVNARYGKQESPSKSFLEVGTSNEVHIMFNCMLPSTLSHLLLLGSSDHRPLASGALVRVPVPVYDLPSCLLSPSLQGPVERMWTVCWIKGRVTSEPSTELDERRMAGSSHGGMLVAVWHASLQLAMVATFLTGE

SEQ ID NO: 1025476 - protein, 84 aa, Homo sapiens
TINKEDHTLGNIIKSQLLKDPQVLFAGYKVPHPLEHKIIIRVQTTPDYSPQEAFTNAITDLISELSLLEERFRVAIKDKQEGIE

SEQ ID NO: 1025477 - protein, 85 aa, Homo sapiens
IGEDNNFHHGETAYDMIPEFKYDLTYGNLAPRGPRIRNEGPDSPTVCPSLIRADKHHRTIDGTSRNSPHRTGLILRYCFSSVKKM

SEQ ID NO: 1025478 - protein, 321 aa, Homo sapiens
MSLDEPSFLRPSRGSRSAESLWMNCTACFIRRCCRSDAASRMSVSLRPPSVRSPEENIAEAPGGPGSPQPPGSLSLELLQRRKGPEPPPFIAERDVAGSSQCALRGAGPAQSPRPARLPRVPRPASRVPCSPGGKAGEEAAALVGTDPAVRESTAAFSPKLPLLRGGPASPGLGVGSGGPMPWKPRPSLPLAEGTCSPVNAVADPGITDSRAMPRSPAARAAARILRNAPPRRQPGLQVNRPGPEDWRLPPRLGALRISPTSGSVDGAHEIEKYRGTRYVCISKEFMVHAESGINDHNSSLHAEHVSSTVLPALYTRKHYV

SEQ ID NO: 1025479 - protein, 90 aa, Homo sapiens
KKFGKLSDCAKKGNPQNQGHMAKKVLNPLRKSCYASRMTSKAPLPTLSDLHCNKLHVDPENFLLLGNVILIVLATHFSEDFTLQIQASWQ

SEQ ID NO: 1025480 - protein, 75 aa, Homo sapiens
MQLRLPLGPRVSVSEPQPECALESRWDARWALVILSPLQAQAGAVMAPLHSNLGNRVRPCLYKIKTKIKKSMWFL

SEQ ID NO: 1025481 - protein, 107 aa, Homo sapiens
IRNEGQVSLLQGPASWTEEVDSQERQEWPLLTISALKGPRVAMLTAFPPAPTCLLRGTPYPGIDIHLVILIIVSGDKLSQLLSHMAHRSLEVPRILSGKTMGPKRSS

SEQ ID NO: 1025482 - protein, 107 aa, Homo sapiens; identical to SEQ ID NO: 1025481

SEQ ID NO: 1025483 - protein, 107 aa, Homo sapiens; identical to SEQ ID NO: 1025481

SEQ ID NO: 1025484 - protein, 75 aa, Homo sapiens; identical to SEQ ID NO: 1025480

SEQ ID NO: 1025485 - protein, 182 aa, Homo sapiens
MGPPGVGRRLVVEVLGAHSGRSPPSRDLEDNCTQRHPVRRQNKGVGKRALSTTAHNTPPGKRKMRRTTREGTNTTTSAPIVKPGESGHNTPYSVRTKVITHTRVRDPHAVRGSPTEYRGKIAGPHIGPPGVPGWSRPPSAKRTPGGNYSPVCTRRWGTNNNSNIVATNAEWRHKRRRVERDN

SEQ ID NO: 1025486 - protein, 161 aa, Homo sapiens
LACEREEPPVCAIDGRDRAGRRIERPAQEVPDAHLRNVAARIQPDHRRRTAVVAVRTLVPELDTASTPGARNRPECFRRSASASAKPSRKMLSPPVASLARQCRNCTPGCNSRVGKSVCGGRFSDVYALLSGRGFDSTSNRTPKLLSRIRPMRRAISSTRP

SEQ ID NO: 1025487 - protein, 195 aa, Homo sapiens [sequence omitted]

SEQ ID NO: 1025488 - protein, 215 aa, Homo sapiens
HEGIAGALQRLWETLCLPVQVLRSDPSIMTWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIKTMVDATGDMSNVQTPRFATRRIPWSPQPAVAQDLIQGTHVEIP

SEQ ID NO: 1025489 - protein, 233 aa, Homo sapiens
MPEARLLLLASVLLGLVLLVVLLLRSEALGWGLCLIGWNEFILQPIHNLLMGDTKEQRFLNQVLLACGSPGTPKSVLEAIDDLICEQKEWAMKRGLPRKGKIVDAVIQGAPALRAAGSLGGPTVWLLRLCAMARLLSPGAEAASPSRINPRTVPAITQRDGAFPLALKRQGHPCGWKPSQENHSPKVEEQGLNVDHTGAWSSFDHWKARVRADTASLGRNVGCCEAALLWLQQ

SEQ ID NO: 1025490 - protein, 85 aa, Homo sapiens
QIPRGPCSLSLPSILQEFCLNEKKNRSTGELRNRWELRAAEGQDSVCSPQRPSAWLVETTSSATLLRLGLPDGPAEGALVKSHFP

SEQ ID NO: 1025491 - protein, 561 aa, Homo sapiens
MSVRYSSSSKQFSSSRSGGGGGGGSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKERYDQHGNSRQGEPRDYSKYYKTIDDLKNQILNLTTDNANILLQIDNARLAADDFRLKYENEVALRQSVEADINGLRRVLDELTLTQADLEMQIESLTEELAYLKKNREEEMKHLRNVSTGDVNVEMNAAPGVDLTQLLNNMRNQYEQLAEQNRKDAEAWFNEKSKELTTEIDNNIEQISSYKSEITELRRNVQALEIELQSQLALKQSLEASLAETEGRYCVQLSQIQAQISALEEQLQEIRAETECQNTEYQQLTDIKIRLENEIQTYRSLLEGEGSSGGGGRGGGSFGGGYGGGSSGGGSSGGGYGGGSSSGGHGGSSSGGYGGGSFGGGGGGYGGGSSGGGSSSGGGYGGGSSSGGGYGGGSSSGGHKSSSSGSVGESSSKGPRY

SEQ ID NO: 1025492 - protein, 250 aa, Homo sapiens
HLLDHHLLHHYRTSVGPSTGLAPEYTILGAPPFLISPGMSGLRGLRYRSTFNLLGHYHLGRPPGLCHTISRHTSLAETEGRYCVQLSQIQAQISALEEQLQEIRAETECQNTEYQQLTDIKIRLENEIQTYRSLLEGEGSSGGGGRGGGSFGGGYGGGSSGGGSSGGGYGGGSSSGGHGGSSSGGYGGGSSGGGGGGYGGGSSGGGSSSGGGYGGGSSSGGGYGGGSSSGGHKSSSSGSVGESSSKGPRY

SEQ ID NO: 1025493 - protein, 263 aa, Homo sapiens
HLLDHHLLHHYRTSVGPSTGLAPEYTILGAPPFLISPGMSGLRGLRYRSTFNLLGHYHLGRPPGLCHTISRHTSLAETEGRYCVQLSQIQAQISALEEQLQEIRAETECQNTEYQQLTDIKIRLENEIQTYRSLLEGEGSSGGGGRGGGSFGGGYGGGSSGGGSSGGGYGGGSSSGGHGGSSSGGYGGGSSGGGGGGYGGGSSGGGSSSGGGYGGGSSSGGGYAAESGGERSGGGYGGGSSSGGHKSSSSGSVGESSSKGPRY

SEQ ID NO: 1025494 - protein, 269 aa, Homo sapiens
HLLDHHLLHHYRTSVGPSTGLAPEYTILGAPPFLISPGMSGLRGLRYRSTFNLLGHYHLGRPPGLCHTISRHTSLAETEGRYCVQLSQIQAQISALEEQLQEIRAETECQNTEYQQLTDIKIRLENEIQTYRSLLEGEGSSGGGGRGGGSFGGGYGGGSSGGGSSGGGYGGGHGGSSGGGYGGGSSGGGSSGGGYGGGSSSGGQAGGSSSGGHGGSSSGGYGGGSSGGGGGGYGGGSSGGGRLRRRIRRRQLQRRPQVLLFRVRGRVFI

SEQ ID NO: 1025495 - protein, 111 aa, Homo sapiens
GRASCSFPPLGLSGAAALASLPTGRTAPNLPDAYGKELFDKANKHHFLHSLALLGVPHCRKPLWAGLLLASGTTLFCTSFYYQALSGDPSIQTLGPPGGTLLLLGWLALAL

SEQ ID NO: 1025496 - protein, 136 aa, Homo sapiens
APAAAFRRLLVRSCGLSFASYGAHAPDAYGKELFDKANSSFLRLRFLRGARAPNLPDAYGKELFDKANKHHFLHSLALLGVPHCRKPLWAGLLLASGTTLFCTSFYYQALSGDPSIQTLGPPGGTLLLLGWLALAL

SEQ ID NO: 1025497 - protein, 193 aa, Homo sapiens
QCPQKRSGPGRISESPSRESGLSRHFEAWQTEARNAAVLDLCHALLLPEMVMHVAAGCAVLVAAPDVMLVCDVPVVGGGLLMLLPGPWTWHWSLVLADLLAPACQPAPALGPHVPMPCPLDLKDALVLEVQAAARFAHHNLSNTAHWAAAVGHAQHRRCSGPSLAGHPTQATQQAQATGYPRHPRPQTTGLTP

SEQ ID NO: 1025498 - protein, 124 aa, Homo sapiens
MGKNQSRKTRNSKNQSASPPPKERSSSPATEQSWTENGLDELREEGLRRSNYSELKEEVGTDGKEVKNLEKKLDKWLTRITNAEKSLKELMELKTTAENYVTNAQASVANAINWKKEYQRWKPK

SEQ ID NO: 1025499 - protein, 80 aa, Homo sapiens
IRNEVGPCLLHLLTQFLQGRVRAFTHGTVQDMMLLREYRQLQEQQSLLPSLSPQPSPLFSKKQPEDNGAPLLLPIKRLEC

SEQ ID NO: 1025500 - protein, 123 aa, Homo sapiens
GGCLREAAAGHVTGRPHGRRPSSARPEPRPDPGHGVLLQKDERGLGPGPRGAEVLLDPSSPPTKALNGAEPNYHSLPSARTDEQALLSSILAKTASNIIDVSVCRLTVALEQHEYMDRARELQ

SEQ ID NO: 1025501 - protein, 76 aa, Homo sapiens
GHGGTLLNGWIPFIHAVSSLDWFVGECTSYWEHGCDKAKPSLGFGSLPLTFSALFDTANSPHQKQVRCQCYACTAC

SEQ ID NO: 1025502 - protein, 107 aa, Homo sapiens
TKKLAGRGGACLIHVHGRVYKVTRIHRLSHMLTNVIRRPYTFTLADPSPQCKLCARVNLNFTQCKSEHTLCAGFKEPSTKPVCMAYRHILLDNDYLLFFLFFLYLPV

SEQ ID NO: 1025503 - protein, 107 aa, Homo sapiens; identical to SEQ ID NO: 1025502

SEQ ID NO: 1025504 - protein, 193 aa, Homo sapiens
ISVEKVNYQIADQHILHDVDWQIPAGAHITLTGPSGGGKSTLLRIIAAMISKTSGTLIFDGQPIESYDPIMYRRQVSYCFQQPTLFGETVADNLAFPYQIRKQVMDTQRVVTPLNNVGLSERTLHQPIIELSGGERQRVGVFRTILFFTKVLLLDEVTACLDENNKQIVHALLRQLMSRSRDNVMITHDATEI

SEQ ID NO: 1025505 - protein, 113 aa, Homo sapiens
ALSPSLPTRFASGPNLKELAPPPRPQPRPRPCLLGLTHNLRSLLLIPVPFPLSRSKLSRQSATEIPLPMLPLADTEKLIREKDEELRRMQEMLEKMQAQMQQSQAQGEQSDAL

SEQ ID NO: 1025506 - protein, 113 aa, Homo sapiens; identical to SEQ ID NO: 1025505

SEQ ID NO: 1025507 - protein, 446 aa, Homo sapiens
MSHHDDGATVGLGIQMCEGWRVEAALSFLPHQRKWGETAGAVMAGGVMDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGSGGGILGAGAFREELGGLCPLRLGNDQSLGCRLRPLDVAFLRAVHEKVNIIPVIGKADALMPQETQALKQKIRDQLKEEEIHIYQFPECDSDEDEDFKRQDAEMKESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 1025508 - protein, 367 aa, Homo sapiens
MDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGLRPLDVAFLRAVHEKVNIIPVIGKADALMPQETQALKQKIRDQLKEEEIHIYQFPECDSDEDEDFKRQDAEMKESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 1025509 - protein, 501 aa, Homo sapiens
MSHHDDGATVGLGIQMCEGWRVEAALSFLPHQRKWGETAGAVMAGGVMDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGSGGGILGAGAFREELGGLCPLRLGNDQSLGCRLRPLDVAFLRAVHEKVNIIPVIGKADALMPQETQALKQKIRDQLKEEEIHIYQFPECDSDEDEDFKRQDAEMKVWKQRRKAGRARWLTSVIPALWEAETGGSPEVRSSRPAWATWRDPTSTKNTQICQESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 1025510 - protein, 183 aa, Homo sapiens
IRHAEEAEEAGVEIEAGKEKVSAVCANGEPLPPALQESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 1025511 - protein, 214 aa, Homo sapiens
MSHHDDGATVGLGIQMCEGWRVEAALSFLPHQRKWGETAGAVMAGGVMDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGSGGGILGAGAFREGWGVSAP

SEQ ID NO: 1025512 - protein, 180 aa, Homo sapiens
RLGSEAWVVHIYQFPECDSDEDEDFKRQDAEMKESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 1025513 - protein, 390 aa, Homo sapiens
PCLTTMMELQWDLESRCVKDGGLKDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGLRPLDVAFLRAVHEKVNIIPVIGKADALMPQETQALKQKIRDQLKEEEIHIYQFPECDSDEDEDFKRQDAEMKESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 1025514 - protein, 469 aa, Homo sapiens
MSHHDDGATVGLGIQMCEGWRVEAALSFLPHQRKWGETAGAVMAGGVMDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGLRPLDVAFLRAVHEKVNIIPVIGKADALMPQETQALKQKIRDQLKEEEIHIYQFPECDSDEDEDFKRQDAEMKVWKQRRKAGRARWLTSVIPALWEAETGGSPEVRSSRPAWATWRDPTSTKNTQICQESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 1025515 - protein, 199 aa, Homo sapiens
MSVIVARFSTVSISVSPEIRDQLKEEEIHIYQFPECDSDEDEDFKRQDAEMKESIPFAVVGSCEVVRDGGNRPVRGRRYSWGTVEVENPHHCDFLNLRRMLVQTHLQDLKEVTHDLLYEGYRARCLQSLARPGARDRASRSKLSRQSATEIPLPMLPLADTEKLIREKDEELRRMQEMLEKMQAQMQQSQAQGEQSDAL

SEQ ID NO: 1025516 - protein, 367 aa, Homo sapiens; identical to SEQ ID NO: 1025508

SEQ ID NO: 1025517 - protein, 113 aa, Homo sapiens
MGFHHVAQAGLELPTSGDPSALASQSAGITGVSHRTWPQASISLALNHSWLGPSPVEPAPQPGVLLKCSKVVNPQPFPSPVARFCRSPLKAVAWAVPSFIPASRAKPRRQRLQ

SEQ ID NO: 1025518 - protein, 145 aa, Homo sapiens
MGFHHVAQAGLELPTSGDPSALASQSAGITGVSHRTWPQASISLALNHSWLGPSPVEPAPQPGVLLKCSKVVNPQPFPSPVARFCRSPLKAVAWAVPSFIPASRAKPRYPLVPCRGVAASSLGKGQGVISSFSGLSVLVPVTSVN

SEQ ID NO: 1025519 - protein, 53 aa, Homo sapiens
MTHGDNETQHFGNRLNGKTFLRVSGLKKLSVNGTDSNPQSGTVYCSQEYNPRL

SEQ ID NO: 1025520 - protein, 208 aa, Homo sapiens
LYGGPRVACLCQVVCSAHLSGRLGVYDSFVFYPGCPCLASCRCFARWWVVVAVDLGECRISLAWWCSPACVVAGSAERKLAQSWGYVRKAACCGAPPMSLILGRITDMGLQALFVQWRRDSADPMPQDAPAMPRALGRCCSTIRASLHGAWWMRSGVAWLMTVHVVDTSIPDPCVLSSMRGDRRSLGPSVLQEYFALCRPYVSSTLPE

SEQ ID NO: 1025521 - protein, 118 aa, Homo sapiens
MASGHGFSSPVIIQGLSCMKTGLSQFNLTRASWSTPRPLPVPYDSPHQMTLAKSRFLCGQGWLADWWKSRVDPKEAHVSSQHQFCTSSASVLVGVPVSPGPGWARALIREDAFAGRGG

SEQ ID NO: 1025522 - protein, 323 aa, Homo sapiens
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNIFGDMLCPRGEVPTLRQLWSRGQQVIVSYEDESSLRRHHELWPGVPYWWGNRVKTEALIRYLETMKSCGRPGGLFVAGINLTENLQYVLAHPSESLEKMTLPNLPRLSAWVREQCPGPGSRCTNIIAGDFIGADGFVSDVIALNQKLLWC

SEQ ID NO: 1025523 - protein, 343 aa, Homo sapiens
VAHACNPSTAEVAVARGSPLMGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNIFGDMLCPRGEVPTLRQLWSRGQQVIVSYEDESSLRRHHELWPGVPYWWGNRVKTEALIRYLETMKSCGRPGGLFVAGINLTENLQYVLAHPSESLEKMTLPNLPRLSAWVREQCPGPGSRCTNIIAGDFIGADGFVSDVIALNQKLLWC

SEQ ID NO: 1025524 - protein, 323 aa, Homo sapiens; identical to SEQ ID NO: 1025522

SEQ ID NO: 1025525 - protein, 358 aa, Homo sapiens
MGGQVSASNSFSRLHCRNANEDWMSALCPRLWDVPLHHLSIPGSHDTMTYCLNKKSPISHEESRLLQLLNKALPCITRPVVLKWSVTQALDVTEQLDAGVRYLDLRIAHMLEGSEKNLHFVHMVYTTALVEDTLTEISEWLERHPREVVILACRNFEGLSEDLHEYLVACIKNIFGDMLCPRGEVPTLRQLWSRGQQVIVSYEDESSLRRHHELWPGVPYWWGNRVKTEALIRYLETMKSCGRPGGLFVAGINLTENLQYVLAHPSESLEKMTLPNLPRLSAWVREQCPGPGSRCTNIIAGDFIGADGFVSDVIALNQKLLSCWFKFPASQWMPAPFLLPFPKQIVHFCLTRDISFSG

SEQ ID NO: 1025526 - protein, 323 aa, Homo sapiens; identical to SEQ ID NO: 1025522

SEQ ID NO: 1025527 - protein, 323 aa, Homo sapiens; identical to SEQ ID NO: 1025522

SEQ ID NO: 1025528 - protein, 323 aa, Homo sapiens; identical to SEQ ID NO: 1025522

SEQ ID NO: 1025529 - protein, 173 aa, Homo sapiens
SVCGPFHYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHGTEFHNGEKPYGMLRSVGEGVLSSNSVLIQHQRIHTGEKPYECK

SEQ ID NO: 1025530 - protein, 177 aa, Homo sapiens
VGTAYWAYAHSVSSVCLTVCSVHPRFLRMPQFPPYASISSIRPTVSSVCPSFLHTPRFPPYTPQFPPYAPQFPPYAQFPPYTPQFPLYASVSSIRTPVSSIRLSFLCMLQFPPYTSVSSVCLHSFLYKASDFPQYNPTVFLPYNFRFGLVFGKNGIGQTGTIVGVWGKFGVLEGGFL

SEQ ID NO: 1025531 - protein, 49 aa, Homo sapiens
MEGCLGDAVRCRYDVWLEIKAISEVTPAHVMQGAGPGLWRYSAGYTARI

SEQ ID NO: 1025532 - protein, 62 aa, Homo sapiens
HGENHVAQFHQNQYQHQRCGVQQSILTHKEMLVVDGVGHAQMTAYQRTSGLSPMPDSSSWAS

SEQ ID NO: 1025533 - protein, 127 aa, Homo sapiens [sequence omitted]

SEQ ID NO: 1025534 - protein, 127 aa, Homo sapiens [sequence omitted]

SEQ ID NO: 1025535 - protein, 82 aa, Homo sapiens
DFSTSVPPRPGAAPGHILVLSRLQPLRAEVSRSRLLRVEYSYVKTTKLVFKGTKAKRRDGKKVSRSELKPLPLRTLSRSLGS

SEQ ID NO: 1025536 - protein, 127 aa, Homo sapiens [sequence omitted]

SEQ ID NO: 1025537 - protein, 82 aa, Homo sapiens; identical to SEQ ID NO: 1025535

SEQ ID NO: 1025538 - protein, 704 aa, Homo sapiens
MAVPPRGGRAAHMAAIRALQQWCRQQCEGYRDVNICNMTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 1025539 - protein, 916 aa, Homo sapiens
MAVPPRGGRAAHMAAIRALQQWCRQQCEGYRDVNICNMTTSFRDGLAFCAILHRHRPDLINFSALKKENIYENNKLAFRVAEEHLGIPALLDAEDMVALKVPDRLSILTYVSQYYNYFHGRSPIGGMAGVKRASEDSEEEPSGKKAPVQAAKLPSPAPARKPPLSPAQTNPVVQRRNEGAGGPPPKTDQALAGSLVSSTCGVCGKHVHLVQRHLADGRLYHRSCFRCKQCSCTLHSGAYKATGEPGTFVCTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 1025540 - protein, 855 aa, Homo sapiens
EGVGTDPGLCQKRCPHGYLSPVPGPPGPPRAPRPVLGTGTSGGTETLSEPGLGPSRSLLDSPIGGMAGVKRASEDSEEEPSGKKAPVQAAKLPSPAPARKPPLSPAQTNPVVQRRNEGAGGPPPKTDQALAGSLVSSTCGVCGKHVHLVQRHLADGRLYHRSCFRCKQCSCTLHSGAYKATGEPGTFVCTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 1025541 - protein, 239 aa, Homo sapiens
VWYVGLDGQVPEAHPAPSPGRPLSPANVPALPGETVTSPVRVSSGGEPGRGPDLRHPHRPSVSQLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 1025542 - protein, 863 aa, Homo sapiens
MAVPPRGGRAAHMAAIRALQQWCRQQCEGYRDVNICNMTTSFRDGLAFCAILHRHRPDLINFSALKKENIYENNKLAFRVAEEHLGIPALLDAEDMVALKVPDRLSILTYVSQYYNYFHGRSPIGGMAGVKRASEDSEEEPSGKKAPVQAAKLPSPAPARKPPLSPAQTNPVVQRRNEGAGGPPPKTDQALAGSLVSSTCGVCGKHVHLVQRHLADGRLYHRSCFRCKQCSCTLHSGAYKATGEPGTFVCTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPGASPARQPRGPSQGCRGAQDVWGPAL

SEQ ID NO: 1025543 - protein, 86 aa, Homo sapiens
LRGTQSGQVLTWEGTGLPADSEAQGGLWPVEGKDVSGRGTCVGHGCAAAALSTASLSTCPLGLQRKKSKFRLSKIWSPKSKSSPSQ

SEQ ID NO: 1025544 - protein, 901 aa, Homo sapiens
MAVPPRGGRAAHMAAIRALQQWCRQQCEGYRDVNICNMTTSFRDGLAFCAILHRHRPDLINFSALKKENIYENNKLAFRVAEEHLGIPALLDAEDMVALKVPDRLSILTYVSQYYNYFHGRSPIGGMAGVKRASEDSEEEPSGKKAPVQAAKLPSPAPARKPPLSPAQTNPVVQRRNEGAGGPPPKTDQALAGSLVSSTCGVCGKHVHLVQRHLADGRLYHRSCFRCKQCSCTLHSGAYKATGEPGTFVCTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLRGLQRKKSKFRLSKIWSPKSKSSPSQ

SEQ ID NO: 1025545 - protein, 916 aa, Homo sapiens; identical to SEQ ID NO: 1025539

SEQ ID NO: 1025546 - protein, 294 aa, Homo sapiens
RGCRACDANPVQSGGPGMGMAGLPSELLAVLGQTPGSQWPCSEAVALSPYLGAARSPSPPRRRRLAVPASLDVCDNWLRPEPPGQEARVQSWKEEEKKPHLQGKPGRPLSPANVPALPGETVTSPVRVSSGGEPGRGPALRHPHRPSFPAAPRLPLPGGDTEAAAGHREAAGRPGAPRRGAGEATAGGRGRSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 1025547 - protein, 98 aa, Homo sapiens
MSGALHASDHVPNARSAKSQPLRRAAVSADDGAPDSSNSMEMKMQEHSDQVPVGNSPSVVSRMLAEKEQNTRQLPTRVDHAQLSLASFHCQILAHWSS

SEQ ID NO: 1025548 - protein, 86 aa, Homo sapiens
MSGALHASDHVPNARSAKSQPLRRAAVSADDGAPDSSNSMEMKMQEHSDQVPVGNSPSVVSRRYVVSRLGNPCVLSFYQHRDTTRD

SEQ ID NO: 1025549 - protein, 257 aa, Homo sapiens
VGRRRGALCRLRVAAPPGRVGRGARCLAAVLTLMRSRKLTGAVRSSARLKARSCSAARLASAQEVAGSTSAKTACLTSSSHKATDRRTSKKFKCDKGHLVKSELQKLVPKNDSASLPVTPETPCAVQQGAASLPLGGCRVVSDSRLAKTRDGLSVPKHSAGSGAEESNSSSTVQKQNEPGLQTEDVQKPPLQMDNSVFLDDDSNQPMPVSRFFGNVELMQDLPPASSSCPSMSRREFRKMHFRAKDDDDDDDDDAEM

SEQ ID NO: 1025550 - protein, 276 aa, Homo sapiens
VGRRRGALCRLRVAAPPGRVGRGARCLAAVLTLMRSRKLTGAVRSSARLKARSCSAARLASAQEVAGSTSAKTACLTSSSHKATDRRTSKKFKCDKGHLVKSELQKLVPKNDSASLPKVTPETPCENEFAEGSALLPGSEAGVSVQQGAASLPLGGCRVVSDSRLAKTRDGLSVPKHSAGSGAEESNSSSTVQKQNEPGLQTEDVQKPPLQMDNSVFLDDDSNQPMPVSRFFGNVELMQDLPPASSSCPSMSRREFRKMHFRAKDDDDDDDDDAEM

SEQ ID NO: 1025551 - protein, 136 aa, Homo sapiens
CRITASPAATMKWGRALSPWTSGRPITHDACSLQLGSQFIGTPCRGAATQLSREHRPKGAVLCTWGGQCSSWDTALHPVLSAPTRPFWKTCPLIPLITLCLESPSGALPAKGHPLGRLRAEPQPRGPQYPQKPLNH

SEQ ID NO: 1025552 - protein, 121 aa, Homo sapiens
EGRRQQRVVSPFLALLTLEPTFHHLLPIMQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 1025553 - protein, 69 aa, Homo sapiens
EGRRQQRVVSPFLALLTLEPTFHHLLPIMQVSTAALAVLLCTMALCNQVLSAPRESMLLLWVSPLSGHG

SEQ ID NO: 1025554 - protein, 41 aa, Homo sapiens
TAVYYCARDGSVLLAYCGGDCYSMDWFDPWGQGTLVTVSSG

SEQ ID NO: 1025555 - protein, 31 aa, Homo sapiens
TAVYYCTTRSTGDKIRFDPWGQGTLVTVSSG

SEQ ID NO: 1025556 - protein, 69 aa, Homo sapiens
MAMRLQPEPPSPWAASRGLPQLSQPLSLSFLGTRLAPDPVPTLHLARGHEDDGCEGTLTSWEYKNALTC

SEQ ID NO: 1025557 - protein, 110 aa, Homo sapiens
ARVLPGSLLRLRRREWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 1025558 - protein, 176 aa, Homo sapiens
ARVLPGSLLRLRRREWPGSRDKRTLACLIQNFMPEDISVQWLHNEVQLPDARHSTTQPRKTKGSGFFVFSRLEVTRAEWEQKDEFICRAVHEAASPSQTVQRAVSVNPELDVCVEEAEGEAPWTWTGLCIFAALFLLSVSYSAALTLLMVQRFLSATRQGRPQTSLDYTNVLQPHA

SEQ ID NO: 1025559 - protein, 100 aa, Homo sapiens
ARVLPGSLLRLRRREWPGSRDKRTLACLIQNFMPEDISVQWLHNEVQLPDARHSTTQPRKTKGSGFFVFSRLEGSIQLCSGEDWPDLLSTVAMTPGSYPQ

SEQ ID NO: 1025560 - protein, 92 aa, Homo sapiens
MFTKSFASMVDKSGKCPGSPALQRLSWLCRHLACTLPIARIPKRKVSSAEGATKEEPKRRLVQLSAKPAPAKVELKLKKAAAKDKSSDKKVQ

SEQ ID NO: 1025561 - protein, 109 aa, Homo sapiens
SAQGCAPGHSRALTVTALAGPASPRVWPAAPVPFTTPALTLLTLIWFGFGLLLKEGKERREELQEHKPRGPMCQQAPRLTTPCPEPRPRTPRPRQGSSFLPFQFLGSHC

SEQ ID NO: 1025562 - protein, 143 aa, Homo sapiens
MGSSPFRSDPFLDSLAIVLSTAIKHERAFLPSCSSLELCLFKVLKRTSRSERITILSSTTILSLHINIVSPGRKCLDYLKTRQCVVRSQPGQCVMAGLSPGQVSMQVSLVRCLAGRGPQISALKASKVLSSGLTPLTGRNCYG

SEQ ID NO: 1025563 - protein, 173 aa, Homo sapiens
MTNHVYFNLDGEQSDVRNHKLQILADEYLPVDERRHSARRPEICRRNVFDFRSAKIIASEFLADDDQRKVKGYRSRILVTAKGDGKKVAAHVWSADEKLQLKVYTAPCKFYSGNFLGGTPSRGTEPYPTGKGWLWKASFYRTARTTLKWPQGLLPASQSIPRRNSLLLSNVTP

SEQ ID NO: 1025564 - protein, 117 aa, Homo sapiens
PCPVRRPPSGRVRAFRMRLGRSSGTSVARKTRACRGEAAAPHLPASAFVTQPPHPESLRAAGRPQHLLEDLAFRSDAGPRWAVQAESGGPEGLRWGRDEALGNRHIFLPSDCLLGGH

SEQ ID NO: 1025565 - protein, 116 aa, Homo sapiens
NRLGRRLVLNRPRMKLKSGSTGPKKPRTLVKTKEELHLVMTAPPPPPPPVYEPVSYHVQESLQDEGAEPTGYSAELSSEGIRDDRNEEKRITEAEKNERVQRQLLTLSSELSHGPR

SEQ ID NO: 1025566 - protein, 151 aa, Homo sapiens
ADRMAALRAGEELERQAVQIKSQEQLAALAEYTAKIALLFEARRRLVVWGGESGSTGPKKPRILVKTKEELHLVMTAPPPPPPPVYEPVSYHVQESLQDEGAEPTGYSAELSSEGIRDDRNEEKRITEAEKNERVQRQLLTLSSELSHGPR

SEQ ID NO: 1025567 - protein, 31 aa, Homo sapiens
CAKDFSGNGAGVDSWGQGTLIIVSSPSPTSP

SEQ ID NO: 1025568 - protein, 236 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGMGSSRESRGGWDSRDDFSSGFRDDFLGGRGGSRPGDRRTGPPNGQPLQRWASPPVDPTWISENPHEEERAMGPTIPLKLNSRSPSSVGIPTCKTRGRLK

SEQ ID NO: 1025569 - protein, 216 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPNGQPLQRWASPPVDPTWISENPHEEERAMGPTIPLKLNSRSPSSVGIPTCKTRGRLK

SEQ ID NO: 1025570 - protein, 170 aa, Homo sapiens
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFKNRPIK

SEQ ID NO: 1025571 - protein, 423 aa, Homo sapiens
MDRGQPSLEPAAAAPRASGRCVIAPVRAVLRLRRRVCVLRKRRLLQPGGGPDVGTGAPRPGCSPRAPRADLDQPKFFTFDSPAELPSRTPRKKRRRSRLVLYPETSRKYRPRVEHRSRAQRCLLLLVAIVGFQVLNAIENLDDNAQRYDLDGLEKALQRAVFGQPAAVSRIVALMRDYLATHVHSRPLLLALHGPSGVGKSHVGRLLARHFRSVLEDSALVLQYHARHHCPEARAAQDCREELARRVADVVARAEAEEKTPLLVLDDVELMPRPLLDELHGFLQPQRSHHFHNAIYVLLSGAGGAEVTRFVLQNASRALPLRPDGFRSAEAAAAQAEEDLRASLLAVLSREHPLWQAAAIVPFLLLDKRDVVSCFRDEMAGEGFFPDQARAENLAAQLSFYRVAGREFAVTGCKQVVATVNLL

SEQ ID NO: 1025572 - protein, 423 aa, Homo sapiens; identical to SEQ ID NO: 1025571

SEQ ID NO: 1025573 - protein, 175 aa, Homo sapiens
IWMRYPQAASHHVVELAMRFQPIPVGIDDERRVIAGAVVLALAGPAVVLAAVLECGAVERVDLDRRSGLERQVQPRVGIGSDGARRMLQPQLGFGRTVPDRAVVAIQPRVAECAERVVVEGAAAADVGNAERKVIDHVRLLGLKRDVSAANLLITTTPAACSGVRRVCCRSTRGR

SEQ ID NO: 1025574 - protein, 376 aa, Homo sapiens [sequence omitted]

SEQ ID NO: 1025575 - protein, 104 aa, Homo sapiens
MGQCRSANAEDAQEFSDVERAIETLIKNFHQYSVEGGKETLTPSELRDLVTQQLPHLMPSNCGLEEKIANLGSCNDSKLEFRSFWELIGEAAKSVKLERPVRGH

SEQ ID NO: 1025576 - protein, 89 aa, Homo sapiens
YELIQRIRRLQRNFHQYSVEGGKETLTPSELRDLVTQQLPHLMPSNCGLEEKIANLGSCNDSKLEFRSFWELIGEAAKSVKLERPVRGH

SEQ ID NO: 1025577 - protein, 89 aa, Homo sapiens; identical to SEQ ID NO: 1025576

SEQ ID NO: 1025578 - protein, 89 aa, Homo sapiens; identical to SEQ ID NO: 1025576

SEQ ID NO: 1025579 - protein, 104 aa, Homo sapiens; identical to SEQ ID NO: 1025575

SEQ ID NO: 1025580 - protein, 104 aa, Homo sapiens; identical to SEQ ID NO: 1025575

SEQ ID NO: 1025581 - protein, 104 aa, Homo sapiens; identical to SEQ ID NO: 1025575

SEQ ID NO: 1025582 - protein, 104 aa, Homo sapiens; identical to SEQ ID NO: 1025575

SEQ ID NO: 1025583 - protein, 53 aa, Homo sapiens
MDPNCSCAAGVSCTCASSCKCKECKCTSCKKSCCSCCPVCQVCQAARQRGIGE

SEQ ID NO: 1025584 - protein, 161 aa, Homo sapiens
ERQPAHEQMWGDSLLIMCRCGVPACSHVPMWSARLLTRADVECPPAHVPIWSARLLTRAIVECPPAHTHADVECPPAHTCPCGVPACSHVPMWSARLLTHVPMWSARLLTRAHVECLPAHTRAHVECPPAHTKPWHGGSVGFLSCRPSQTLLPYILLMVAF

SEQ ID NO: 1025585 - protein, 139 aa, Homo sapiens
MSPRFVPMWSARLLTRADVECPPAHVPIWSARLLTRAIVECPPAHTHADVECPPAHTCPCGVPACSHVPMWSARLLTHVPMWSARLLTRAHVECLPAHTRAHVECPPAHTKPWHGGSVGFLSCRPSQTLLPYILLMVAF

SEQ ID NO: 1025586 - protein, 109 aa, Homo sapiens
MSPRFVPMWSARLLTRAHVECPPAHTCPCGVPACSHMSMRSARLLTHVHVECPPAHVPMWSAHLLTCADVECRLLHTRAHVGVARLLHVAHVGVLGLVQQVADVGVRFV

SEQ ID NO: 1025587 - protein, 134 aa, Homo sapiens
MHEPSLCANVECPPAHTCRRGVPACSRAHMECPPAHTCHCGVPACSHTCRVPMWSARLLTRAHVECLPAHTRAHVECPPAHVPMWSAHLLTCADVECRLLHTRAHVGVARLLHVAHVGVLGLVQQVADVGVRFV

SEQ ID NO: 1025588 - protein, 137 aa, Homo sapiens
HVKSCQNKRLKLAQAAFEDAVITKAVENASVDGDEIPEAMIEEDVHRQIDQYLGQLQQQGISRDMFFQISGQTEDDLHKQFEEGAATRVKTNLVLEAIVKAEGIDPTEEQITEEVNNLAAQYNMGPAQIRAHCQIHC

SEQ ID NO: 1025589 - protein, 97 aa, Homo sapiens
AAGASAPGAGAEFGRAEGARERSDAPGRMVLESVARIVKVQLPAYLKRLPAPESITGFARLTVSEWLVMAFPVVYSHLLGYPVQFVHSSRRRNQQKG

SEQ ID NO: 1025590 - protein, 123 aa, Homo sapiens
RRHQYPSEAASTWTIIGLLFDALIDQTTRKTIWGLGRILLQVLHGDHPFYYFVIGQNGPILGSHRRSSIRRLPGNIYHFFGFRLALEPRIWLCTRINDATTNYGSDPTIIENVSSRALHFNQR

SEQ ID NO: 1025591 - protein, 75 aa, Homo sapiens
PLLIGNSWPPFQLAMDPNCSCAAGDSCTCAGSCKCKECKCTSCKKSCCSCCPVGCAKCAQGCICKGGSDKCSCCA

SEQ ID NO: 1025592 - protein, 91 aa, Homo sapiens
MAPEKRFENPIRFGSRAGPKIELNGNPCAPKEGFPEGGTSGARDSGAVVSPTQIKRARGEQPSVFGTHSQRGVRSHRVLHTGPGTDNSRRG

SEQ ID NO: 1025593 - protein, 91 aa, Homo sapiens; identical to SEQ ID NO: 1025592

SEQ ID NO: 1025594 - protein, 68 aa, Homo sapiens
MDPNCSCAAGDSCTCAGSCKCKECKCTSCKKSHFWHLIKDLKGGSLCVCKLMFLGAQIPSNLAGTAIP

SEQ ID NO: 1025595 - protein, 104 aa, Homo sapiens
FGTGNTARPDCASRLTDFLLCAKLWCCASRESPGPLPAIPTKVLPTGKACPLAPTTRDPCPEGGLLGVCGNVGIFCRERGVLLGFEGLKGAEPRPDGLPAPAVT

SEQ ID NO: 1025596 - protein, 109 aa, Homo sapiens
GRARRVKPLIDAISAGCDIARALTHASPQMLNSAAPRHGFKKRTEYRRRIVRTVARLQRHFQRRRNNGTNVTPPVEICRDDAGSSGTPSPFTDQQQSVWDDDFIAAIGR

SEQ ID NO: 1025597 - protein, 744 aa, Homo sapiens
MNTKKLAVTNGVVGLVGGIALLLGGWIVLYSGNRWNRTFAIVNVLFLLLKIATLVLGIVGLVQFSKEAVITKAPSVLLVVGGALAIIPFMGWIGGILSIIGGSIYLAISRNLSNKMAFIAVHIKKGDHDMINNSYLLKADLKREKDIPLISRESIIKLAKAHERGDVRYLNEAETNVYDLLTKIEVKRLASLYKSFIFDFSIEDSTVSYTFADIEEAIRDNIGVKNKRLLEDSTNLMSDIIRFAVTPVDYIFDFHKNDNGNLEVQRDQVLERFIEVLEQQTYENVWSDLMKYPFDNQTHGIRKHLMLGVAASTGKSIILEAIGKLYEASASFKSNRPENGFDAANWNADIIDKFVVLLDDDNPNVSINEDYLKNFLSNNMPQQLARGGGQRWSEIYYGSSVIALNTAPDFLKNQQNNKRVIFLKLTQSIEEMFTSEELNHLHNLEPKHILGYVNSEPTKLFKWRNDWSGVIEDLKEDVKQHISMRGYASLNDLKKTFGDKVMRDYQRTVEKAKNITVNGEAFYGLRQDAIIDEPYRVDQLTFSAFINLHDVIGERNFESLDEFKNDIEEYGKLKKEEQPLFSPAVYHDELTKANLTGFVGVVLDIDGANAADMDELEDKIAMTGISAVAWETASSTPSSLRARIWFYRVGGGLEEYASLVKKIAMKIDEPFDRASMPAEHRFFIGGTNVRLINTDSTAAENKPMTDMKKRGLVRAVQNAKDGEREQITYWALMRAEQENGGKEF

SEQ ID NO: 1025598 - protein, 53 aa, Homo sapiens
MTRTSTAAENKPMTDMKKRGLVRAVQNAKDGEREQITYWALMRAEQENGGKEF

SEQ ID NO: 1025599 - protein, 128 aa, Homo sapiens
MSLRIGSSLEKPEETHVEPLLLRVDLCGRRHLVQRPVHVRMAFGETNACGIGTIAELMMPNARRPTSGPTREIDRAIELRDDQWHLLLQCFPCLGQFDTMLRAHEQRGAELLEQPEFPGSAAAARYGA

SEQ ID NO: 1025600 - protein, 128 aa, Homo sapiens
MEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEEKVAHAKRRKP

SEQ ID NO: 1025601 - protein, 279 aa, Homo sapiens
DKYSEALKDAQEKLELAEKKATDAEADVASLNRRIQLVEEELDRAQERLATALQKLEEAEKAADESERGMKVIESRAQEDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDEAVRSETEVQSHQRGAGPRSQRYDFHISFFASVLPRLPRRAGCPTSLSSAVVYVSSLTLGLSALDIPAFRCQGTALLL

SEQ ID NO: 1025602 - protein, 617 aa, Homo sapiens
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 1025603 - protein, 604 aa, Homo sapiens
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 1025604 - protein, 335 aa, Homo sapiens
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPVEF

SEQ ID NO: 1025605 - protein, 510 aa, Homo sapiens
MSSRHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 1025606 - protein, 448 aa, Homo sapiens
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGKKFLCKVYKRKLLGYVYFN

SEQ ID NO: 1025607 - protein, 383 aa, Homo sapiens
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLESLFETSHLVEHPLAFGHLDVARLLPSQSLQGLPFHPFAAPRGPVVPPV

SEQ ID NO: 1025608 - protein, 599 aa, Homo sapiens
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 1025609 - protein, 494 aa, Homo sapiens
MLVPLAKLSCLGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 1025610 - protein, 617 aa, Homo sapiens; identical to SEQ ID NO: 1025602

SEQ ID NO: 1025611 - protein, 67 aa, Homo sapiens
MLGSTLTGRVHGRKGAGFLEDVGATLWGPGFSRHLARSGHLGLVVGPGWSGAGAAQAPTVNPAPWLW

SEQ ID NO: 1025612 - protein, 116 aa, Homo sapiens
ASKNLSGIPQGCREFSTEVVFVAKYIFGKDRALLEAPGCWHYRVLRATLPVCEHPCSQMWLQAVALGFPSRSWEAGGKLRFLFRRASDLPLQDVCYYYYRKRTPLSTSHKVRSKGH

SEQ ID NO: 1025613 - protein, 440 aa, Homo sapiens [sequence omitted]

SEQ ID NO: 1025614 - protein, 218 aa, Homo sapiens
MKGAKCCRDQGRRKDVTSRSWGHGQRQGRFITDGKSVADHVHRGGPEQRSDMRTQENSGPGSGTAVHPHPGRGWHLRRHSCPSLARSNLGTDGGEEGQLEEAHFRKLPTEPVSILQTSSACRGSLTRQQGGPHQPTPMPGTPFTSGRVLKTPESSALCIKHRLRPCTQEDAILSLKSRAHHPGRSSLQTSLQTQRRPLELTTPGVRHCRHHCRHRDGH

SEQ ID NO: 1025615 - protein, 104 aa, Homo sapiens
MKGAKCCRDQGRRKDVTSRSWGHGQRQGRFITDGKSVADHVHRGGPEQRSDMRTQENSGPGSGTAVHPHPGRGWHLRRHSCPSLARSNLGTDGGRGRATRGGTF

SEQ ID NO: 1025616 - protein, 104 aa, Homo sapiens; identical to SEQ ID NO: 1025615

SEQ ID NO: 1025617 - protein, 104 aa, Homo sapiens; identical to SEQ ID NO: 1025615

SEQ ID NO: 1025618 - protein, 154 aa, Homo sapiens
KKKLWAINRTKKQGNEALFPLWGFPFSGLCANPAPPSGAAGLKGRNSVGGGCEFADPGSLLCSGGGKLQFDRDPPSLSPLLSRPRPGVLAVGSSEVGEACGVEGPAPAPAPVTPSCCLLHAQGTPMVQSSGKARTGLRPCVEMLHQRKAETRLP

SEQ ID NO: 1025619 - protein, 1255 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 1025620 - protein, 515 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPPPGSTAPPAHGVTSAPDTRPPPGSTAPAAHGVTSAPDTRPAPGSTAPPAHGVTSAPDNRPALASTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 1025621 - protein, 347 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPPPGSTAPPAHGVTSAPDTRPPPGSTAPAAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMVSIGLSFPMLP

SEQ ID NO: 1025622 - protein, 197 aa, Homo sapiens
MFGGDFPTARDPQGNYFIDRDGPLFRYVLNFLRTSELTLPLDFKEFDLLRKEADFYQIEPLIQCLNDPKPLYPMDTFEEVVELSSTRKLSKYSNPVAVIITQLTITTKVHSLLEGISNYFTKWNKHMMDTRDCQVSFTFGPCDYHQEVSLRVHLMEYITKQGFTIRNTRVHHMSERANENTVEHNWTFCRLARKTDD

SEQ ID NO: 1025623 - protein, 237 aa, Homo sapiens
MDNGDWGYMMTDPVTLNVGGHLYTTSLTTLTRYPDSMLGAMFGGDFPTARDPQGNYFIDRDGPLFRYVLNFLRTSELTLPLDFKEFDLLRKEADFYQIEPLIQCLNDPKPLYPMDTFEEVVELSSTRKLSKYSNPVAVIITQLTITTKVHSLLEGISNYFTKWNKHMMDTRDCQVSFTFGPCDYHQEVSLRVHLMEYITKQGFTIRNTRVHHMSERANENTVEHNWTFCRLARKTDD

SEQ ID NO: 1025624 - protein, 237 aa, Homo sapiens; identical to SEQ ID NO: 1025623

SEQ ID NO: 1025625 - protein, 284 aa, Homo sapiens
ARALRPRASPGPAAAAAAAAHFPETWALEDASLEQMDNGDWGYMMTDPVTLNVGGHLYTTSLTTLTRYPDSMLGAMFGGDFPTARDPQGNYFIDRDGPLFRYVLNFLRTSELTLPLDFKEFDLLRKEADFYQIEPLIQCLNDPKPLYPMDTFEEVVELSSTRKLSKYSNPVAVIITQLTITTKVHSLLEGISNYFTKWNKHMMDTRDCQVSFTFGPCDYHQEVSLRVHLMEYITKQGFTIRNTRVHHMSERANENTVEHNWTFCRLVTGMSYSRFPDYWDPQIQ

SEQ ID NO: 1025626 - protein, 272 aa, Homo sapiens
ARALRPRASPGPAAAAAAAAHFPETWALEDASLEQMDNGDWGYMMTDPVTLNVGGHLYTTSLTTLTRYPDSMLGAMFGGDFPTARDPQGNYFIDRDGPLFRYVLNFLRTSELTLPLDFKEFDLLRKEADFYQIEPLIQCLNDPKPLYPMDTFEEVVELSSTRKLSKYSNPVAVIITQLTITTKVHSLLEGISNYFTKWNKHMMDTRDCQVSFTFGPCDYHQEVSLRVHLMEYITKQGFTIRNTRVHHMSERANENTVEHNWTFCRLARKTDD

SEQ ID NO: 1025627 - protein, 256 aa, Homo sapiens
ARALRPRASPGPAAAAAAAAHFPETWALEDASLEQMDNGDWGYMMTDPVTLNVGGHLYTTSLTTLTRYPDSMLGAMFGGDFPTARDPQGNYFIDRDGPLFRYVLNFLRTSELTLPLDFKEFDLLRKEADFYQIEPLIQCLNDPKPLYPMDTFEEVVELSSTRKLSKYSNPVAVIITQLTITTKVHSLLEGISNYFTKWNKHMMDTRDCQVSFTFGPCDYHQEVSLRVHLMEYITKQGFTIRNTRSNLRCDAAYTTH

SEQ ID NO: 1025628 - protein, 402 aa, Homo sapiens
MHMQGQTHSRIPQGTAGTQLLGKKCFALRMASRLAKEEGWLAEHMLILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTNVTPIGYIPKEDALNLKGLGHINMMELFSISKEFWDKEVEDIEKYLVDQVNADLPCEIEREILALKQRISQM

SEQ ID NO: 1025629 - protein, 622 aa, Homo sapiens
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVPIPKTGLSQLGRWMSEEDFEKAFNARFPGCMKGRTMYVIPFSMGPLGSPLSKIGIELTDSPYVVASMRIMTRMGTPVLEALGDGEFVKCLHSVGCPLPLQKPLVNNWPCNPELTLIAHLPDRREIISFGSGYGGNSLLGKKCFALRMASRLAEEEGWLAEHMLILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTNVTPIGYIPKEDALNLKGLGHINMMELFSISKEFWDKEVEDIEKYLVDQVNADLPCEIEREILALKQRISQM

SEQ ID NO: 1025630 - protein, 181 aa, Homo sapiens
WVPTAPGQRGGTRGPSSPGPWQGDWAVLWRDPDHGAFCHGGGCCNQGHGKITGSQDGGGSSPNLERPPPRACPCFGPVLSWTPPTFFFFLVFPPSICRGAPALYLGPLGGRCGLGEAALLFSPHTTALVGVQGVGCCLWLSLFRPPRHSIWNQKAVDSGKWSLCPPHSSLVWSPVAHSPLP

SEQ ID NO: 1025631 - protein, 180 aa, Homo sapiens
WVPTAPGQRGGTRGPSSPGPWQGDWAVLWRDPDHGAFCHGGGCCNQGHGKITGSQDGGGSSPNLERPPPRACPCFGPVLSWTPPTFFFFLVFPPSICRGAPALYLGPLGGRCGLGEAALLFSPHTTALVGGGVGFFFFFFFFFFFLNSIWNQKAVDSGKWSLCPPHSSLVWSPVAHSPLP

SEQ ID NO: 1025632 - protein, 234 aa, Homo sapiens
RNNLDLLNDRERTTDRRKTTRARDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANACLPI

SEQ ID NO: 1025633 - protein, 267 aa, Homo sapiens
IRLQHSRVRRERSTKDWRVKLRRGSSFLNISYTLSRRPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANACLPI

SEQ ID NO: 1025634 - protein, 286 aa, Homo sapiens
KKYIEIRKEAREAANGDSGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANACLPI

SEQ ID NO: 1025635 - protein, 296 aa, Homo sapiens [sequence omitted]

SEQ ID NO: 1025636 - protein, 170 aa, Homo sapiens
KVMRVEPNKMKKKWKSQAASMLIQRLKHVAEDATVNMNEVGALTSWLIIWELIWNSVQQRVGLSSQIGKSVPSLNEMHIEETVTNNLYTSTVRLRLRSNLAEGRRDLRPEIKVLSDKLKEAETRAEFAERSVTKLEKSIDDLEDELYAQKLKYKAISEELDHALNDMTSI

SEQ ID NO: 1025637 - protein, 140 aa, Homo sapiens
GQLSLLWGFKDGLGWIIRNGIGIHEHASIDLPGIKGLWPLRSDPNRETDDTLVLSFVGQTRVLMLNGEEVEETELMGFVDDQQTFFCGNVAHQQLIQITSASVRLVSQEPKALVSEWKEPQAKNISVDSCNSMTSVVGGL

SEQ ID NO: 1025638 - protein, 153 aa, Homo sapiens
MSITTGQKLLKSRILFHPRSLRGLQMILNSDRYAPSLHELGHFNIPTLCDPANLQWFILTKAQQARENMKRKEELKVIENELIQASTKKFSLEKLYKEPSISSIQMVDCCKRLLEQSLPYLHGMHLCISHFYSVMQDGDLCIPWNWKNGEAIK

SEQ ID NO: 1025639 - protein, 246 aa, Homo sapiens
RLAQQNLETLKKAKGCTIIFTDRSGMSAVGHVMLGTMDVHHHWTKLFERLPSYFDLQRRLMILEDQISYLLGGIQVVYIEELQPVLTLEEYYSLLDVFYNRLLKSRILFHPRSLRGLQMILNSDRYAPSLHELGHFNIPTLCDPANLQWFILTKAQQARENMKRKEELKVIENELIQASTKKFSLEKLYKEPSISSIQMVDCCKRLLEQSLPYLHGMHLCISHFYSVMQDGDLCIPWNWKNGEAIK

SEQ ID NO: 1025640 - protein, 117 aa, Homo sapiens
VECGKESTDTSPTLYWEPASAPDPQCERGPHVADGKKGCPELLSREAVAEPPSPTSHGIRRQQKLWGTEFATGVPADNRLKELPDTLGELRSLRTLDISENEVRRLPQMLAHVRTLE

SEQ ID NO: 1025641 - protein, 69 aa, Homo sapiens
VLNVERNQLTHLPRSIGNLLQLQTLSVKDNRLKELPDTLGELRSLRTLDISENEVRRLPQMLAHVRTLE

SEQ ID NO: 1025642 - protein, 133 aa, Homo sapiens
MSRRGWMSEAGKKQHRLAWVFAPGPGLEPAPLPAPGKSETTRGGAAAGGWAAAPWRVPEGRSQGLGVPAGGASRGRGGPLCLLHRVSYFVTKVLQPLAPAGTLGRPAASCRRHGTLGQQHPGPAAGGRVPGAP

SEQ ID NO: 1025643 - protein, 197 aa, Homo sapiens
MEPLASNIQVLLQAAEFLERREREAEHGYASLCPHRSPGPIHRRKKRPPQAPGAQDSGRWRAQLKRCLERLKQQMPLGADCARYTTLSLLRRARMHIQKLEDQEQRARQLKERLRSKQQSLQRQLEQLRGLAGAAERERLRADSLDSSGLSSERSDSDQEELEVDVESLVFGGEAELLRGFVAGQEHSYSHGGGAWL

SEQ ID NO: 1025644 - protein, 147 aa, Homo sapiens
MRPCARIAVQAPSTGGRSDPPRLLARRTAGGEEAGGGGSGGGGGRRPWSGPPLPTCCLHLLGQVSRSRKRSDPSCHLPTLQTHSHLSYSFKDYFLSTSRCAGNCQQQLGSRFHSHSRTPDIRPLTSPAGFLLFSPLPSPLHMLFPPI

SEQ ID NO: 1025645 - protein, 118 aa, Homo sapiens
MNWRSAGESQSCADSAMPPGATALWPSLPCHSCGRHEVGLALPSRPLPHRRAQLKRCLERLKQQMPLGADCARYTTLSLLRRARMHIQVEAPHCARTGLPWCMEGCAMEGLVGLGNET

SEQ ID NO: 1025646 - protein, 206 aa, Homo sapiens
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQEELEVDVESLVFGGEAELLRGFVAGQEHSYSHGGGAWL

SEQ ID NO: 1025647 - protein, 397 aa, Homo sapiens
MNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVATKWQVSREDQDKVAVLSQNRTENAQKAGHFDKEIVPVLVSTRKGLIEVKTDEFPRHGSNIEAMSKLKPYFLTDGTGTVTPANASGINDGAAAVALMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 1025648 - protein, 388 aa, Homo sapiens
GQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVATKWQVSREDQDKVAVLSQNRTENAQKAGHFDKEIVPVLVSTRKGLIEVKTDEFPRHGSNIEAMSKLKPYFLTDGTGTVTPANASGINDGAAAVALMKKSEADKRGLTPLARIVSWSQVGVEPSIMGIGPIPAIKQAVTKAGWSLEDVDIFEINEAFAAVSAAIVKELGLNPEKVNIEGGAIALGHPLGALGGPIFGPRSPPLKRMGRN

SEQ ID NO: 1025649 - protein, 85 aa, Homo sapiens
FTWMGLIYRDGVMQAMDFDKSQFLFRNPHCDLGEKLPGTHWPSNHIYSSQGLIPFYMGFIPAMQDNYALFGNRTRRYWKELGKAK

SEQ ID NO: 1025650 - protein, 87 aa, Homo sapiens
LQALETVNGVAWKWTGKEGLQWSSQTGNRDFFPSSIYPGLAASLPTPAPVLCCLEATWTFMRCILFCLWWMGWCKAQDLALPEVATC

SEQ ID NO: 1025651 - protein, 220 aa, Homo sapiens
LTFCRRVWAVVRQHISTDHQGQFVFVGSYNAGNVSVTVLEDGLPVGVVDVVEGLDGCHSANISPDNRTLWVPALKQDRICLFTVSDDGHLVAAGPAEVTTVEGAGPRHMVFHPNEQYAYCVNELNSSVDVWELKDPHGNIECVQTLDMMPENFSDTVGRLIFISPRMVANLYACDRTASLITVFSVSEDGSVLSKEASSLRNPSARFNVDHSGKYLIAAG

SEQ ID NO: 1025652 - protein, 172 aa, Homo sapiens
RPVGAKDGSENLAGKPALQIPSSRAAAPRPPVSAASGRPQDDTDSSRASLPELPRMQRPSLPDLSRPNTTSSTGMKHSSSAPPPPPPGRRANAPPTPLPMHSSKAPDYNREKPLPPTAGTKGFTLGREGPPASTPSQTTSFPCEYQNRTKWPVSGSSSSALPPASWGPQWTL

SEQ ID NO: 1025653 - protein, 420 aa, Homo sapiens
PNILETTEGLELLKTAHWATAGYTDKVVIGMDVAASEVLSGLGKYAPGLQVSRMIPSRYHLAWTSLAAPVQVLPSRTHPSGVYRSIPLHQACTGEHWPEVPQPSARHIPGQCAGIASPPVHPTQQQASPTGRATQQVRATLPTCIKRQPREAPMTDVYLQRVHSWTQANWYGASWCLHTLRRDDWQIPSIADLVVRTCATGPGSTTGCPFADTEALGHVTTKIPPHLTADAGTNHRAQGMGRPGHHRNTTLGPSNGLWSQGHTQRSHMLRPTQKPLTIGGPAIRPVQGQRTQNDDTGYPVQAYKRPKSHEDTSHTRDTANERTRTPTPPDHHPWHARHTQHEHKRPRAVEIATQNTKRIHPRTTTHPEDTTAKPKGGPTMRDPAGNTKREHTARNSTRHKKQQKTPPDSEKHNRRRNNVT

SEQ ID NO: 1025654 - protein, 104 aa, Homo sapiens
QPPPPLVGPGSTSSPQSLCEDRKRRSGSHHLGNGCFVLVMSTRHLIFWTPSPPQPLFLSPLTQRRLSDASFSLLGQSRSEEGKEGLGVRGQAMAKGPAAPHLSL

SEQ ID NO: 1025655 - protein, 113 aa, Homo sapiens
MNICIEEATLYYLLLKTPYLGVVAHARNRSTLGGQGGRIMRSGDRDHPGQQRRNPVSIYSFLESSTPGNFFHVLRRQILLPFRKPLIIFTPKSQYANDAHAFAVTSAPAASGR

SEQ ID NO: 1025656 - protein, 1061 aa, Homo sapiens
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 1025657 - protein, 1065 aa, Homo sapiens
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYCSLSCDWDTLGHLSIT

SEQ ID NO: 1025658 - protein, 110 aa, Homo sapiens
SDAAGYLEYPNRHDKEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 1025659 - protein, 102 aa, Homo sapiens
EVPATSKEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 1025660 - protein, 114 aa, Homo sapiens
SDAAGYLEYPNRHDKEQLRLRIGIHTGPVCAGVVGLKMPRYCLFGDTVNTASRMESNGEALKIHLSSETKAVLEEFGGFELELRGDVEMKGKGKVRTYCSLSCDWDTLGHLSIT

SEQ ID NO: 1025661 - protein, 1059 aa, Homo sapiens
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYCCLSAIGNPG

SEQ ID NO: 1025662 - protein, 1075 aa, Homo sapiens
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGRVEKPAALPTFWGPRGSYPSQAANATPIPKALI

SEQ ID NO: 1025663 - protein, 1061 aa, Homo sapiens; identical to SEQ ID NO: 1025656

SEQ ID NO: 1025664 - protein, 262 aa, Homo sapiens
LGASVGEIGTRDKVNPQPDFCCTGAPNDPESGVGLGPGPRVLATRTPSSLALEWLDEVHSLVHSDTVKSQLCARSEMASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 1025665 - protein, 193 aa, Homo sapiens
MRLERSEMASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 1025666 - protein, 171 aa, Homo sapiens
MTQNLGSEMASILRSPQALQLTLALIKPDAVAHPLILEAVHQQILSNKFLIVRMRELLWRKEDCQRFYREHEAGQSEPTSLPTRMPSSSGGRSWDPPECSEHAMWPQILSVGVSASLTPATPPMVRTLWFQPAERLQPSSLTSVNSAGMRRKSPSCAVALCAIAQREVSTM

SEQ ID NO: 1025667 - protein, 186 aa, Homo sapiens
MASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 1025668 - protein, 230 aa, Homo sapiens
LGASVGEIGTRDKVNPQPDFCCTGAPNDPESGVGLGPGYEGRSEMASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 1025669 - protein, 247 aa, Homo sapiens
MHAPGKPATLQDNSQPHLTPRRNRTRTPSRAAQERLKDPARAAGYPGGAWWPGPVPEDRSEMASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 1025670 - protein, 224 aa, Homo sapiens
MHAPGKPATLQDNSQPHLTPRRNRTRTPSRAAQERLKDPARAAGYPGGAWWPGPVPEDRSEMASILRSPQALQLTLALIKPDAVAHPLILEAVHQQILSNKFLIVRMRELLWRKEDCQRFYREHEAGQSEPTSLPTRMPSSSGGRSWDPPECSEHAMWPQILSVGVSASLTPATPPMVRTLWFQPAERLQPSSLTSVNSAGMRRKSPSCAVALCAIAQREVSTM

SEQ ID NO: 1025671 - protein, 194 aa, Homo sapiens
MTQNLGSEMASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 1025672 - protein, 215 aa, Homo sapiens
MHAPGKPATLQDNSQPHLTPRRNRTRTPSRAAQERLKDPARAAGYPGGAWWPGPVPEDKAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 1025673 - protein, 131 aa, Homo sapiens
LGASVGEIGTRDKVNPQPDFCCTGAPNDPESGVGLGPGYEGILDLSVVVNQESRQPQLSCVSKGTMSSLQVGLGPGPRVLATRTPSSLALEWLDEVHSLVHSDTVKSQLCARYCLHLLVVKTELKGTCKEL

SEQ ID NO: 1025674 - protein, 337 aa, Homo sapiens
MWQVLEPTSYSILCLIRRPYPICHCSAKPIYAPTSCIRRLYWVPGPNPAFNLVALSYSGGGTSQEGKGQTSPNRWANFQTFQLEELPPDTLLTEPVAWLPAQPCPNGCEGSALERPEGWNCMGPVWTHSLCPRDALYRLLIGDEYTYNPRPAARVSQAAHPKEEQQKGDGQQKSTEDEPKEHKTNEYQDKMEQERERDKKARLAKYNRECANMETSKHLRKKPYSKRAHSGDHTTTRYKNMRHNQYTITTIQKERQEQGGKQPDTGRETDNKEQRTDNTNQENSTTSQTENKSDHDARAATSNRKTKHHDQQRHRHEHTHNRQHHQNKNDDRSRPTE

SEQ ID NO: 1025675 - protein, 80 aa, Homo sapiens
HQHLSKESAGNKPANAVLHKVLKQLEELLSDMKADVTRLPATIARIPPVAVRLQMSERNILSRLANRAPEPTPQQVAQQQ

SEQ ID NO: 1025676 - protein, 81 aa, Homo sapiens
PWNPKPRKNGKAFNPGAKIGAPLGNGPPIARENPFQKRVAMDPKFKSRYSGLTPGLKKIEEPKNPPILFNPLECISRSLQD

SEQ ID NO: 1025677 - protein, 178 aa, Homo sapiens
MYLVRSRGQAWQWAVLTCCGEPLSCGTRSLRAYAIETLSQAAILFTIAHVYDHRVTFTHGPGKLLLEIQTKVLGSEILTELRCILGFLAHTLVLNFVSHLHRPSSQERSGTVKAAGVQSSRATVFIFGRESPLSLYNEELVSMNVQGDYEPTDATGFININSLRLKEYHRLQSKVTAK

SEQ ID NO: 1025678 - protein, 84 aa, Homo sapiens
MLKAKDGPHVAAASFHGGTSLGVSNVAAKGWHFFKYNKWVLFLFFYCERSFGLHVDTCQVIIVMRCLINRSGLYKQARLSSLDG

SEQ ID NO: 1025679 - protein, 178 aa, Homo sapiens
KGDGGGASGVRRRVVVAAGGGGSGGGGVRVCMHAGHQPPKRTQLLRHVPAPGGMHWTLRRLADDGMWLLTHMLRNELEHMPCDYMTLDDVGLAVSSLTGAIGHHACVNVASAAPVPQCLGTQPWMPPPSWVPDGKLGSKAASSTKRIPASAIVLLQVELLPYSFPMSPPCLALAQARG

SEQ ID NO: 1025680 - protein, 360 aa, Homo sapiens
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERMLEANDGSGMLDEDEEDLQRALALSRQEIDMEDEEADLRRAIQLSMQGSSRNISQDMTQTSGTNLTSEELRKRREAYFEKQQQKQQQQQQQQQQQQQQQQQQQQQQRDLSGQSSHPCERPATSSGALGSDLGKACSPFIMFATFTLYLT

SEQ ID NO: 1025681 - protein, 384 aa, Homo sapiens
GVGAVGSRQINMESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERMLEANDGSGMLDEDEEDLQRALALSRQEIDMEDEEADLRRAIQLSMQGSSRNISQDMTQTSGTNLTSEELRKRREAYFEKQQQKQQQQQQQQQQQQQQQQQQQQQQRDLSGQSSHPCERPATSSGALGSDLGDAMSEEDMLQAAVTMSLETVRNDLKTEGKK

SEQ ID NO: 1025682 - protein, 384 aa, Homo sapiens; identical to SEQ ID NO: 1025681

SEQ ID NO: 1025683 - protein, 622 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 1025684 - protein, 119 aa, Homo sapiens
MAHVRGLQLPGCLALAALCSLVHSQHVFLAPQQARSLLQRVRRANTFLEEVRKGNLERECVEETCSYEEAFEALESSTATVSLGCSDEYRGLRPGPTLDTSTEKQARNATAPSLLTAVD

SEQ ID NO: 1025685 - protein, 472 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLAGAT

SEQ ID NO: 1025686 - protein, 99 aa, Homo sapiens
GAILAHCSLPLPLVQILLPQPPEELVPTGYKPDEGKRGDACEGDSGGPFVMKSPFNNRWYQMGIVSWGEGCDRDGKYGFYTHVFRLKKWIQKVIDQFGE

SEQ ID NO: 1025687 - protein, 494 aa, Homo sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAARLQA

SEQ ID NO: 1025688 - protein, 328 aa, Homo sapiens
MTQKRGSRSHIEDTNEQSKNREEGQTYNKREKAEKSRKERTPKEEKRKQPGKKRKKGQRAPTRSKNNTKKKQEHNNVQSKRHKSKDEKRARDRKKQKPTGTKKKEKKTESAKETRNNETEGEDRKNKAEGENERREKQKQETTRRPPREQNTQGDESREHQREKRKTKEEGKKSNTRKKQARTEKQTREKNEDRKARTHAGEKGKMQQRKREERTKETRDTRSGGKSRDHSRTGQRAQQRGPRRENGGKRTRAKRKGDGKNNRNGEKEKKKKRKEQEEKRRKKTTREKKRKKQERRTTKRKENRSRKNKRDKNKNHDRQERRTKHKGK

SEQ ID NO: 1025689 - protein, 331 aa, Homo sapiens
MHKRHKNEAAEAISEDTNEQSKNREEGQTYNKREKAEKSRKERTPKEEKRKQPGKKRKKGQRAPTRSKNNTKKKQEHNNVQSKRHKSKDEKRARDRKKQKPTGTKKKEKKTESAKETRNNETEGEDRKNKAEGENERREKQKQETTRRPPREQNTQGDESREHQREKRKTKEEGKIEQHTKEASEDRETDKRKKEDRKARTHAGEKGKMQQRKREERTKETRDTRSGGKSRDHSRTGQRAQQRGPRRENGGKRTRAKRKGDGKNNRNGEKEKKKKRKEQEEKRRKKTTREKKRKKQERRTTKRKENRSRKNKRDKNKNHDRQERRTKHKGK

SEQ ID NO: 1025690 - protein, 79 aa, Homo sapiens
LDQIPSYDTHKIAVLYVGEGQSNSELAILSNEHGSYRYTEFLTGNGPAHREKDGQSDKVAIESLVALVMTAHYILRSTT

SEQ ID NO: 1025691 - protein, 198 aa, Homo sapiens
ILEGNNIFPPRNNPLPCVFPSPDFPPPKRDKNWEAPPGGGPLLKILDPPGSKNSAQSWGPRSVANMQLFVRAQELHPFEVTGQETVAQIKAHVASLEGIAPEDQVVLLAGAPLEDEAPLGQCGVEALTTLEVAGRMLGGKVHGSLARAGKVRGQTPKVAQQEKKKKKTGRAKRRMQYNRRFVNVVPPFGKKKGPNANS

SEQ ID NO: 1025692 - protein, 198 aa, Homo sapiens
ILEGNNIFPPRNNPLPCVFPSPDFPPPKRDKNWEAPPGGGPLLKILDPPGSKNSAQSWGPRSVANMQLFVRAQELHPFEVTGQETVAQIKAHVASLEGIAPEDQVVLLAGAPLEDEAPLGQCGVEALTTLEVAGRMLGGKVHGSLARAGKVRGQTPKVAQQEKKKKKTGRAKRRMQYNRRFVNVVPPFGKKKGPNANF

SEQ ID NO: 1025693 - protein, 198 aa, Homo sapiens; identical to SEQ ID NO: 1025692

SEQ ID NO: 1025694 - protein, 167 aa, Homo sapiens
SDVTRSQVCTDAPRFFLFLDSIFRGSWDRRSVANMQLFVRAQELHPFEVTGQETVAQIKAHVASLEGIAPEDQVVLLAGAPLEDEAPLGQCGVEALTTLEVAGRMLGGKVHGSLARAGKVRGQTPKVAKQEKKKKKTGRAKRRMQYNRRFVNVVPPFGKKKGPNANS

SEQ ID NO: 1025695 - protein, 167 aa, Homo sapiens
SDVTRSQVCTDAPRFFLFLDSIFRGSWDRRSVANMQLFVRAQELHPFEVTGQETVAQIKAHVASLEGIAPEDQVVLLAGAPLEDEAPLGQCGVEALTTLEVAGRMLGGKVHGSLARAGKVRGQTPKVAKQEKKKKKTGRAKRRMQYNRRFVNVVPPFGKKKGPNANF

SEQ ID NO: 1025696 - protein, 101 aa, Homo sapiens
YPVCCVEVSLFIPCRCREQKAVWNQHHRALWEKRKTCSLRSAGSWRVLGPCVVVHRILAFFLLSLYIGLREYTVSLCEYGQLAFTNMYLSTFSCLKKEKKT

SEQ ID NO: 1025697 - protein, 101 aa, Homo sapiens; identical to SEQ ID NO: 1025696

SEQ ID NO: 1025698 - protein, 137 aa, Homo sapiens
MSADLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMAAIRRASAILRSQKPVMVKRKRTRPTKSS

SEQ ID NO: 1025699 - protein, 87 aa, Homo sapiens
SVPKREASRGQVRKPADFIALGAGGSGALGGAGPLPLHHHRLLAAQDGAWPVRIGCQCAGRGGTCSCRIMCLMLLSVHEHFCDGSPL

SEQ ID NO: 1025700 - protein, 174 aa, Homo sapiens
MSADLQWMVVRNCSSFLIKRNKQTYSTEPNNLKARNSFRYNGLIHRKTVGVEPAADGKGVVVVIKRRSGQRKPATSYVRTTINKNARATSAADGKGVVVVIKRRSGQRKPATSYVRTTINKNARATLSSIRHMIRKNKYRPDLRMAAIRRASAILRSQKPVMVKRKRTRPTKSS

SEQ ID NO: 1025701 - protein, 137 aa, Homo sapiens; identical to SEQ ID NO: 1025698

SEQ ID NO: 1025702 - protein, 219 aa, Homo sapiens
CLLIRLTEHRFGSIKQCTAIRMLWAALSRVLQPCAVGPCLTMMPYIVECTVVASLASNSLCLHEHVASRPFPGGEPSDPGTRGVCCCCSPAHQCLASLPPSLDRAVEMAPAAWGKPNCQNSSHLSTIQEAGYCPASAFSVSAGSAQSPHPPKSPRWTASPTPPGPSQEPRLAISIYCLRPCRPWATGLAPVPPGSQCHHPRQAFPDPARNKQGTKCTHC

SEQ ID NO: 1025703 - protein, 297 aa, Homo sapiens
PPPPGPASSFSCLVAASACAVGGGRRPASAALSVPPRFFLPFTPDGLCFSDVVLEHAILPGPVVAPVTVCCLAVSCVVVMLGVLCVIALASCVCAWCLSSMPLLLPVPCPLVAVGPCLTMMPYIVECTVVASLASNSLCLHEHVASRPFPGGEPSDPGTRGVCCCCSPAHQCLASLPPSLDRAVEMAPAAWGKPNCQNSSHLSTIQEAGYCPASAFSVSAGSAQSPHPPKSPRWTASPTPPGPSQEPRLAISIYCLRPCRPWATGLAPVPPGSQCHHPRQAFPDPARNKQGTKCTHC

SEQ ID NO: 1025704 - protein, 297 aa, Homo sapiens; identical to SEQ ID NO: 1025703

SEQ ID NO: 1025705 - protein, 148 aa, Homo sapiens
MACRASLMFPILCGPRVCAPLGLLPPEGPFLVLGPMCLVLNTVGGLSPGTLRVSGTSPRPLAAAFDTTLLPRDRSSGPPRGTEAEMADEIATGSVSLGPGGDTIFGKIIRPGKYQAKIRFVMDDRLPVTFPLDHLPRFNGPPHRAIFW

SEQ ID NO: 1025706 - protein, 148 aa, Homo sapiens; identical to SEQ ID NO: 1025705

SEQ ID NO: 1025707 - protein, 181 aa, Homo sapiens
MAGSREVVAMDCEMVGLGPHRESGLARCSLVNVHGAVLYDKFIRPEGEITDYRTRVSGVTPQHMVGATPFAVARLEILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPRLAVSD

SEQ ID NO: 1025708 - protein, 181 aa, Homo sapiens; identical to SEQ ID NO: 1025707

SEQ ID NO: 1025709 - protein, 181 aa, Homo sapiens; identical to SEQ ID NO: 1025707

SEQ ID NO: 1025710 - protein, 128 aa, Homo sapiens
SLASPSPTQKMGHVGVGTCLPGQILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPRLAVSD

SEQ ID NO: 1025711 - protein, 161 aa, Homo sapiens
MAGSREVVAMDCEMVGLGPHRESGLARCSLVNVHGAVLYDKFIRPEGEITDYRTRVSGVTPQHMVGATPFAVARLEALKEDMSGYTIYDTSTDRLLWREAKLDHCRRVSLRVLSERLLHKSIQNSLLGHSSVEDARATMELYQISQRIRARRGLPRLAVSD

SEQ ID NO: 1025712 - protein, 166 aa, Homo sapiens
GTDADRREVMVACEQGEISAVASLVALAQVGVSCWGPATWQVPLGLSQMKEEGFNIQICPRILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPRLAVSD

SEQ ID NO: 1025713 - protein, 257 aa, Homo sapiens
MAGSREVVAMDCEMVGLGPHRESGLARCSLVNVHGAVLYDKFIRPEGEITDYRTRVSGVTPQHMVGATPFAVARLEILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPAVVEGAISRRGLSLGFLAATPAWNHFCKETHKHKKNTAQKKVVRRGEKKCGRIKVRIAGAKTRDTVVPDHIRNMTKPVSPSE

SEQ ID NO: 1025714 - protein, 118 aa, Homo sapiens
MAGSREVVAMDCEMVGLGPHRESGLARCSLVNVHGAVLYDKFIRPEGEITDYRTRVSGVTPQHMVGATPFAVARLEVPFPYSPTEACVKASCLACVTEREDDMWEAGQKKRRGWDITR

SEQ ID NO: 1025715 - protein, 120 aa, Homo sapiens
AFLLTENGATCGLYVILQLLKGKLVVGHDLKHDFQALKEDMSGYTIYDTSTDRLLWREAKLDHCRRVSLRVLSERLLHKSIQNSLLGHSSVEDARATMELYQISQRIRARRGLPRLAVSD

SEQ ID NO: 1025716 - protein, 166 aa, Homo sapiens
MAGSREVVAMDCEMVGLGPHRESGLARCSLVNVHGAVLYDKFIRPEGEITDYRTRVSGVTPQHMVGATPFAVARLELSEGQASRGFGNNPSPTSLAPLPWCPSVTCDPTCKISHTAVGRKPVVSPSHPGEGFLSSENHRLTSGSRLWGIYLDLVQLAGLKMGKLSS

SEQ ID NO: 1025717 - protein, 181 aa, Homo sapiens; identical to SEQ ID NO: 1025707

SEQ ID NO: 1025718 - protein, 290 aa, Homo sapiens
MMVNHNFTSFTSNERAVVKLNEVMQAALVNSDDRDWRYFVMLVPVLYDMQQFLVKEGSMNERFVAQAPKFDINFWRMIITVMAINFFKWQGKDVAELMKTSSAIDDLQFKFLQVDDKDDHFNLPVIAETFRGLSPKMKPLKGADSVVALEPKLTEAQIQAELEFADKRLAQFKAASVKDVVSDNVVNMLRGFHEGLATEYQATHDLWQPAMFNALATDKLFNYWSPAWDNLDGIGGEVKSYLTFLSQKQDISGLSEFVTGTAGIDRYIDVAALNHLLEQMPEDVLAERAL

SEQ ID NO: 1025719 - protein, 185 aa, Homo sapiens
PRLCGRMKECVPATERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNTQDLLAEKVLAGKIQKLRTTFQNLLGKLLLRMLLPSPERTHA

SEQ ID NO: 1025720 - protein, 127 aa, Homo sapiens
PCNPSSRDKVNFHMFDVGGQRDERRKWIQCFNDVTAIIFVVASSSYNMVIREDNQTNRLQEALNLFKSIWNNRWLRTISVILFLNTQDLLAEKVLAGKIQKLRTTFQNLLGKLLLRMLLPSPERTHA

SEQ ID NO: 1025721 - protein, 50 aa, Homo sapiens
RKRSLSEASNARKAMQNFMFCYLIFFWLPNRFSRRLRKSVRLLIRLPPLF

SEQ ID NO: 1025722 - protein, 53 aa, Homo sapiens
ENVHYQRQVTHERRAEFHVLLPHILLVAKQIYACADFCNPVYAASVDYCVDVN

SEQ ID NO: 1025723 - protein, 144 aa, Homo sapiens
MQSLLLPYRSDPKFPAILEELTTANISRTKSYMRQPDGEHTAVRRPANGMSKRDEYYNSDKPVMTSGITSGAVIHKGKAIDPRNLPKTSTTAAIVPRIAAAVAGQAAIVRLKPTALIIRHRITHHTSALTSRAHTVTSFEMLNE

SEQ ID NO: 1025724 - protein, 241 aa, Homo sapiens
GGGGSGGDGDMESGAYGAAKAGGSFNLRRFLTQPQVVARAVCLVFALIVFSCIYGEGYSNAHKSKEMYCVFNRNEDAFRYGSAIGVLAFLALGFFFGGCCKTLISPPYQTTLMTSSQLVRWVTCSSQFSGPSCGVWGFCFLTNQWAVTNPKDVLVGADSVRAAITFSFFSIFSWGVLASLAYQRYKAGVDDFIQNYVDPTPDPNCLRLYPGASVDNNNSHLHQNAETTDGTSALCTERRLA

SEQ ID NO: 1025725 - protein, 113 aa, Homo sapiens
CGRGARDEAMALEAAGGPPEETLSLWKREQARLKAHVVDRDTEAWQRDPAFSGLQRVGGVDVSFVKGDSVRACASLVVLSFPELEVTWEDAELEAGPSVGSGVRSPGQGAVQA

SEQ ID NO: 1025726 - protein, 246 aa, Homo sapiens
MEQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSGEGQPPQDHSPGPRTAPRPGSQEQAGKDWQ

SEQ ID NO: 1025727 - protein, 317 aa, Homo sapiens
CGRGARDEAMALEAAGGPPEETLSLWKREQARLKAHVVDRDTEAWQRDPAFSGLQRVGGVDVSFVKGDSVRACASLVVLSFPELEVVYEESRMVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSGGAPSPQRQADRTTPGGRRSTAQHQVGQR

SEQ ID NO: 1025728 - protein, 179 aa, Homo sapiens
CGRGARDEAMALEAAGGPPEETLSLWKREQARLKAHVVDRDTEAWQRDPAFSGLQRVGGVDVSFVKGDSVRACASLVVLSFPELEFYAFQVAKPERDLPCTSCFVTAPSSCFGKQALPCLPFGAPEQNSWIPPQEERADGLELGNPGFTTAGILFKPLWVSHAAVGVWPFGPLHLWGKR

SEQ ID NO: 1025729 - protein, 264 aa, Homo sapiens
MALEAAGGPPEETLSLWKREQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSGEGQPPQDHSPGPRTAPRPGSQEQAGKDWQ

SEQ ID NO: 1025730 - protein, 115 aa, Homo sapiens
MALRSHDRSTRPLYISVGHRMSLEAAVRLTCCCCRFRIPEPVRQADICSREHIRKSLGLPGPPTPRSPKAQRPVACPKGDSGESSGEGQPPQDHSPGPRTAPRPGSQEQAGKDWQ

SEQ ID NO: 1025731 - protein, 160 aa, Homo sapiens
CGRGARDEAMALEAAGGPPEETLSLWKREQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKIRLLQTRGDSFPLLGDSGTVLGMG

SEQ ID NO: 1025732 - protein, 134 aa, Homo sapiens
MALRSHDRSTRPLYISVGHRMSLEAAVRLTCCCCRFRIPEPVRQADICSREHIRKSLGLPGPPTPRSPKAQRPVACPKGDSGESSFVERGGESTRPRLIPDRTPVVRAHVLVSFLIERGGESTRPRLVPDRTRW

SEQ ID NO: 1025733 - protein, 318 aa, Homo sapiens
CGRGARDEAMALEAAGGPPEETLSLWKREQARLKAHVVDRDTEAWQRDPAFSGLQRVGGVDVSFVKGDSVRACASLVVLSFPELEVVYEESRMVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSGEGQPPQDHSPGPRTAPRPGSQEQAGKDWQ

SEQ ID NO: 1025734 - protein, 196 aa, Homo sapiens
CGRGARDEAMALEAAGGPPEETLSLWKREQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKVPQPPGPPPAKTCLELPPTLFLLTFPCIFLLWDPMLALGVRHSQWRELLTPPAVSLDGRF

SEQ ID NO: 1025735 - protein, 269 aa, Homo sapiens
VAVCVDGLQRQAGRAGGLGPPEAAVWILGCCPGWGSRVLLRCPLVAALGPCTPTQGQPALSCPEYRGGSPALARVAVLTVLGTVTLEGEAGHQHCPLQDGLGFIWQLLRACVRLVGPCAAQTRCPHFRLRGAEKGAGGGLGGGRHHPSAQGGRVPPGHLGLDVRGLDQGPPEGVDQMLMCSWVQCLCWGLAPPWARVHGGHGPSGEEGGPRAGSRVWRAWEWSPSWGPRRFPQGATGAGAGGGQWTRWGDVETPKAPFQAALPPRPTDG

SEQ ID NO: 1025736 - protein, 78 aa, Homo sapiens
GSRGPGTVRLCPGGEGGQGRLSAAQLRPTCQLLAQLALPVAQHTGCLCGWFPDGEGTLPGAQGLAGVSPRPGSSTAFK

SEQ ID NO: 1025737 - protein, 175 aa, Homo sapiens
MSSKKAKTKTTKKRPQRATSNVFAMFDQSQIQEFKEAFNMIDQNRDGFIDKEDLHDMLASLGKNPTDAYLDAMMNEAPGPINFTMFLTMSGETLHGTDPEDVIRNAFACFDEEATGTIQEDYLRELLTNHGGSVLQMRKWMSCPEKHLLTTRELQVTSAYTHLEAMSRHRCVNEL

SEQ ID NO: 1025738 - protein, 102 aa, Homo sapiens
MSSKKAKTKTTKKRPQRATSNVFAMFDQSQIQEFKEAFNMIDQNRDGFIDKEDLHDMLASLGKNPTDAYLDAMMNEAPGPDVVFFDRVLIGAFTIPELDTEC

SEQ ID NO: 1025739 - protein, 196 aa, Homo sapiens
AEVSAPPLVRPQPNALRCRLRSRAGRPRFWCLASELNNHHVEQFAMFDQSQIQEFKEAFNMIDQNRDGFIDKEDLHDMLASLGKNPTDAYLDAMMNEAPGPINFTMFLTMSGETLHGTDPEDVIRNAFACFDEEATGTIQEDYLRELLTNHGGSVLQMRKWMSCPEKHLLTTRELQVTSAYTHLEAMSRHRCVNEL

SEQ ID NO: 1025740 - protein, 164 aa, Homo sapiens
MSSKKAKTKTTKKRPQRATSNVFAMFDQSQIQEFKEAFNMIDQNRDGFIDKEDLHDMLASLGKNPTDAYLDAMMNEAPGPINFTMFLTMSGETLHGTDPEDVIRNAFACFDEEATGTIQEDYLRELLTNHGGSVLQMRKWMSCPEKHLLRRKGKFQLHRVHTAS

SEQ ID NO: 1025741 - protein, 183 aa, Homo sapiens
RKCRRRHWSGHSLTLFAVVCGLAQGGPGSGVWRRVSRARLCSRDPSGRRLRTPAPPSRRAPAAGPGPGRQAAAGPVRLAEKEARGRRWREEGCWRGPGPDVQVPGGSRRWSRSGETPCWRSGRVPAVRGPALRHLGDLRHLGLGRPAARRQRLPSRRRGGSGGGLGPTRACSCGAPALCPTLS

SEQ ID NO: 1025742 - protein, 211 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPKPCPHLEQGKKGSLWSSEDRTLAW

SEQ ID NO: 1025743 - protein, 246 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGGHRALPSPTLRRSAQRRAHPTGRPRRPRPGLLTAIPPGAFPGARLGGDNQLRRPRALPTEPDVADSHPLHLLSGRDLLMDEVRCVSV

SEQ ID NO: 1025744 - protein, 234 aa, Homo sapiens
RVVSTQSGITAGDSRLAVPPHPAMERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPKPCPHLEQGKKGSLWSSEDRTLAW

SEQ ID NO: 1025745 - protein, 121 aa, Homo sapiens
MPSWPNKAGVSPEWEKIVAFLLISGSSTASTSISTRDPSGCQLRAASQRAESRGEKAITQVSKGTCEQGPSIVTPPKDIWNVTGAQVYLSCEVIGIPKPCPHLEQGKKGSLWSSEDRTLAW

SEQ ID NO: 1025746 - protein, 302 aa, Homo sapiens
QSRGTDPTRVRKASSPRRRFSWNDKEGEFTKGPGEPAKGVPAPQWAAPQRSNSGTASGRAINDAGQRAPVGHLTLLGVNPGIVIDPELNEALSEVGESALKESSSFLRSEAVAQLWGQKKKNSNMTYEKLSRAMRYYYKREILERVDGTGDSSTSFGKNSYVGWKEEDGSPESELKGWNLYPGTKLTDQLRGRANHSWEDRKAKMAPPLEECSQLCCGEKLMFWCFVNHPPWDSENYGLASPTLLFGNYKKPWGGSITFYAASVSRVIWCLSQTQSQTLNADILLPPCSTSWSDAKEAWERP

SEQ ID NO: 1025747 - protein, 35 aa, Homo sapiens
IEQVPQEYLLVSGDRCRSVIIHQIFRDIEQVSQPS

SEQ ID NO: 1025748 - protein, 439 aa, Homo sapiens [sequence omitted]

SEQ ID NO: 1025749 - protein, 176 aa, Homo sapiens
VQRQIAFSVLQHVLGAGATGQGGAATPPAIWHQAVAKATQQPFDVSAFKASYSDSETIGPSEKISQATAAGDVIKAAYNQVKTIAQGNLSNTDVQAAKNKLKAAYLRSGESSECFREEVGSQALVAGSYMPPSTVLQQMDSVANGDIINAAKKFGSGQKSMAASGNWGHTPWVDEW

SEQ ID NO: 1025750 - protein, 190 aa, Homo sapiens
RRFTWCALACAPSSSGRVSLSVPSSPAMAALTRDPQFQKLQQWYREHRSELNLRRLFDANKDRFNHFNMTLNTNHGHILVDYSKNLVTEDVMRMLDGLWTKSKGVRGRPGADDKMGEKINYTGFEPCWHVASAGNRVQNTPHPRQRCNARGSGDEVFMPAVGAVTGYTGNITDINISIGGSELLMVTEAL

SEQ ID NO: 1025751 - protein, 200 aa, Homo sapiens
GPVEYAALQSGPGSGCSALVFCGSRCPLLFVSGNMASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISLEGKPL

SEQ ID NO: 1025752 - protein, 209 aa, Homo sapiens
GPVEYAALQSGPGSGCSALVFCGSRCPLLFVSGNMASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKDAIKKKLTGIKHELQANCYEEVKDRCTLAEKLGGSAVISWRQPLEPFCPLLVQS

SEQ ID NO: 1025753 - protein, 199 aa, Homo sapiens
GPVEYAALQSGPGSGCSALVFCGSRCPLLFVSGNMASGVAVSDGVIKVFNDMKVRKSSTPEEVKKRKKAVLFCLSEDKKNIILEGRGKGRIPGVGGRIWLGGAPQGKTFGSGTGTPLTAHPFVKMLPDKDCRYALYDATYETKESKKEDLVFIFWAPESAPLKSKHELQANCYEEVKDRCTLAEKLGGSAVISLEGKPL

SEQ ID NO: 1025754 - protein, 72 aa, Homo sapiens
QSNQGGQRHQGGQRQMIYASSKDAIKKKLTGIKHELQANCYEEVKDRCTLAEKLGGPEDKHQILPSCPPLCL

SEQ ID NO: 1025755 - protein, 182 aa, Homo sapiens
GPVEYAALQSGPGSGCSALVFCGSRCPLLFVSGNMASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKHELQANCYEEVKDRCTLAEKLGGSAVISLEGKPL

SEQ ID NO: 1025756 - protein, 175 aa, Homo sapiens
GPVEYAVASVGSRQRLQRSRLLRLSVPSPFRFRKHGERQATAPEGGGCSVACTQALENVRTPSPNTPKVSHEGAGAGHVHTRGKAGDVARTPGLPPRYTHDTGSRGGFARGPLAERPASRLSSEGALDWSMRRPNPARGRRGKARVSRAPHPLFLSARHPPSAAGSVSGAGRDVC

SEQ ID NO: 1025757 - protein, 308 aa, Homo sapiens [sequence omitted]

SEQ ID NO: 1025758 - protein, 342 aa, Homo sapiens
MRPEGSLTYRVPERLRQGFCGVGRAAQALVCASAKEGTAFRMEAVQEGAAGVESEQAALGEEAVLLLDDIMAEVEVVAEEEGLVERREEAQPRQQAVPGPGPMTPESALEELLAVQVELEPVNAQARKAFSRQREKMERRRKPHLDRRGAVIQSVPGFWANVIANHPQMSALITDEDEDMLSYMVSLEVEEEKHPVHLCKIMLFFRSNPYFQNKVITKEYLVNITGDRWLPGWVVGGRWWVDHCQRDPAPFPQKSPVSVEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 1025759 - protein, 488 aa, Homo sapiens
MSGLLTDPEQRAQEPRYPGFVLGLDVGSSVIRCHVYDRAARVCGSSVQKVENLYPQIGWVEIDPDVLWIQFVAVIKEAVKAAGIQMNQIVGLGISTQRATFITWNKKTGNHFHNFISWQDLRAVELVKSWNNSLLMKIFHSSCRVLHFFTRSKRLFTASLFTFTTQQTSLRLVWILQNLTEVQKAVEEENCCFGTIDTWLLYKLTKGSVYATDFSNASTTGLFDPYKMCWSGMITSLISIPLSLLPPVRDTSHNFGSVDEEIFGVPIPIVALVADQQSAMFGECCFQTGDVKLTMGTGTFLDINTGNSLQQTTGGFYPLIGWKIGQEVVCLAESNAGDTGTAIKWAQQLDLFTDAAETEKMAKSLEDSEGVCFVPSFSGLQAPLNDPWACASFMGLKPSTSKYHLVRAILESIAFRNKQLYEMMKKEIHIPVRKIRADGGVCKNGFVMQMTSDLINENIDRPADIDMSCLGAASLAGLAVGFGLTRRN

SEQ ID NO: 1025760 - protein, 518 aa, Homo sapiens [sequence omitted]

SEQ ID NO: 1025761 - protein, 152 aa, Homo sapiens
MSGLLTDPEQRAQEPRYPGFVLGLDVGSSVIRCHVYDRAARVCGSSVQKVENLYPQIGWVEIDPDVLWIQFVAVIKEAVKAAGIQMNQIVGLGISTQRATFITWNKKTGNHFHNFISWQDLRAVELVKSWNNSLLMKDIKKTYAHTPHSSEV

SEQ ID NO: 1025762 - protein, 488 aa, Homo sapiens; identical to SEQ ID NO: 1025759

SEQ ID NO: 1025763 - protein, 252 aa, Homo sapiens [sequence omitted]

SEQ ID NO: 1025764 - protein, 112 aa, Homo sapiens
MAKFVIRPATAADCSDILRLIKELAKYEYMEEQVILTEKDLLEDGFGEHPFYHCLVAEVPKEHWTPEGNPRPFPEARGPSVMEKVRVGWVEPLPTQAEVSENLDKKNSQLVF

SEQ ID NO: 1025765 - protein, 128 aa, Homo sapiens
MVLESTPFTTAWLQKCRKSTGLRKDTALLGLAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 1025766 - protein, 143 aa, Homo sapiens
MVLESTPFTTAWLQKCRKSTGLRKDTALLGLAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATKKCMLLQRHLIAVVLRR

SEQ ID NO: 1025767 - protein, 123 aa, Homo sapiens
SSVPSSTETLTSHVMLLLQDTALLGLAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 1025768 - protein, 128 aa, Homo sapiens; identical to SEQ ID NO: 1025765

SEQ ID NO: 1025769 - protein, 90 aa, Homo sapiens
MAKFVIRPATAADCSDILRLIKELAKYEYMEEQVILTEKDLLEDGFGEHPFYHCLVAEVPKEHWTPEGYSLLRHVHGPSYMDGRGGELKD

SEQ ID NO: 1025770 - protein, 123 aa, Homo sapiens
MVLESTPFTTAWLQKCRKSTGLRKDTALLGLAMYYFTYDPWIGKLLYLEDFFVMSDYRGFGIGSEILKNLSQVAMRCRCSSMHFLVAEWNEPSINFYKRRGASDLSSEEGWRLFKIDKEYLLF

SEQ ID NO: 1025771 - protein, 128 aa, Homo sapiens
RPSGADWPITGRKMKVLWAALLVTFLAGCQAKVEQAVETEPGPYLSQQTVWQSGQPWELALGRFWDYLPWVQTLFEQGHEELLTFQVTHELKALIGKTIKELKAYMMGLEEQLFPLAGETLARLANEL

SEQ ID NO: 1025772 - protein, 310 aa, Homo sapiens
LPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRRY

SEQ ID NO: 1025773 - protein, 251 aa, Homo sapiens
LPPLPPIPALPQQPPLPPSQPAFSQVPASSTSTLPPSTHSKTSAVSSQANSQPPVQVSVKTQVSVTAAIPHLKTSTLPPLPLPPLLPGDDDMDRICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRRY

SEQ ID NO: 1025774 - protein, 321 aa, Homo sapiens
LFRTCLCLSEYDAMDVPENSILVEHNLFKQRLDKDGHPREQRLSRHELGKSEVTVCLTPDSPGPLIRCEPAYGCCRTKIQVPVNPVEENGAGEATIPLAGLGPFQSTPHHLFAASPPAASSPSKHAQPASNEGCPGCMAFLEVQISVDRETSHFAPGKSFQQSHVHVHDLQSFGLDNINMTHYIQHLSFGEDYPGIVNPLDHTNVTAPQASMMFQYFVKVVPTVYMKVAGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 1025775 - protein, 253 aa, Homo sapiens
QRGAEAKDIKCCNTCHDVLQAYSGWGCAFKNPDTPEQCRREGFSQKMQEQKNEGCPGCMAFLEVQISVDRETSHFAPGKSFQQSHVHVHDLQSFGLDNINMTHYIQHLSFGEDYPGIVNPLDHTNVTAPQASMMFQYFVKVVPTVYMKVAGEVLRTNQFSVTRHEKVANGLLGDQGLPGVFVLYELSPMMVKLTEKHRSFTHFLTGVCAIIGGMFTVAGLIDSLIYHSARAIQPSWSTSPQRYLNWQEMHQKT

SEQ ID NO: 1025776 - protein, 128 aa, Homo sapiens
MAGGKAGKDSGKAKTKAVSRSQRAGLQFPVGRIHRHLKSRTTSHGRVGATAAVYSAAILEYLTAEVLELAGNASKDLKVKRITPRHLQLAIRGDEELDSLIKATIAGGGVIPHIHKSLIGKKGQQKTV

SEQ ID NO: 1025777 - protein, 242 aa, Homo sapiens
QRGAEAKDIKCCNTCHDVLQAYSGWGCAFKNPDTPEQCRREGFSQKMQEQKNEGCPGCMAFLEVQISVDRETSHFAPGKSFQQSHVHVHDLQSFGLDNINMTHYIQHLSFGEDYPGIVNPLDHTNVTAPQASMMFQYFVKVVPTVYMKVAGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 1025778 - protein, 154 aa, Homo sapiens
MAGGKAGKDSGKAKTKAVSRSQRAGLQFPVGRIHRHLKSRTTSHGRVGATAAVYSAAILEYLTAEVLELAGNASKDLKVKRITPRHLQLAIRGDEELDSLIKATIAGGGVIPHIPHNHLTHKKKKKNNINHCLKDAWIPCYLRTLNTLTAVQCW

SEQ ID NO: 1025779 - protein, 128 aa, Homo sapiens; identical to SEQ ID NO: 1025776

SEQ ID NO: 1025780 - protein, 173 aa, Homo sapiens
MPAITVLLLVCLRLGGLGKAESLCTRSLKAAHGLWISISEQSGQDDDGAEARVKSGQPWCVFGELLLQPGPPVRTPTYMLPGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 1025781 - protein, 74 aa, Homo sapiens
FAAASTETEGMAHAAQVGLQDATSPIIEELITFHDHALIIIFLICFLVLYALFLTLTTKLTNTNISDAQEIETV

SEQ ID NO: 1025782 - protein, 101 aa, Homo sapiens
LNIRKFILERYLTSVKNVAKLLTTPHPFTTHKRIHTGEKPYKCEECGKAFSRSSKLTEHKIIHTGEKPYKCERCDKAFNQSANLTKHKKIHTGEKLQNWNV

SEQ ID NO: 1025783 - protein, 71 aa, Homo sapiens
MEKRRLIERKKKDTHGNASDTRRQGDKHTTSPYDEWTYGRRDIELGQWRRECRIQDKILLSTRERRKNKKR

SEQ ID NO: 1025784 - protein, 101 aa, Homo sapiens
PVGSGVGSLGLFLSFSLCRISRSPDYISKREKKKEKTFKCLLGITVCQVLLHTHTQHIETLTNTINQLDLANICTLYILTRIHIHFRHTWSILSDRPYGWL

SEQ ID NO: 1025785 - protein, 131 aa, Homo sapiens
AFQNDELLLREVLAKHYLKCGNLQNVIQLLVVMSYRELAVYYAGLGIPGGSHCCRLNIPVSQVNPRDAKACVVHGSAPQRHLTSEQLGVTFGDFTTSEYTCVAKGPPFRRSLIMVDGLPRTGGAYPGAGTG

SEQ ID NO: 1025786 - protein, 328 aa, Homo sapiens
SDTYCQTHGEGKTALVKNLEAVRDLGGPHPPSALIKLEHLTQNRDDSGPRVDAFEQVEISTDMLIRRVVITSRCALSMTKHFSRTWTCSVQNLLVLCNMRQVFQAKHGKAYLFLSGQLPGDASEISTSLKVHRAVLWFREGDERQDTPKSVEIPFNSTNKVPVVYSLRTPRASEPQDLLVMKGAPERILDRCSSILLHGKEQPLDEELKDAFQNAYLELGGLGERVLGFCHLFLPDEQFPEGFQFDTDDVNFPIDNLCLSGLISMIDPPRAAVPDAVGKCRSAGIKVIMVTGDHPITAKAIAKGVGIISEGNETVEDIAAASTSQSAR

SEQ ID NO: 1025787 - protein, 61 aa, Homo sapiens
AVTRGRATQVTNMCIGVPWHAQVCTDVPWHPLVYPGVPAIGPWAGAPISSTSIPDVNVYLG

SEQ ID NO: 1025788 - protein, 187 aa, Homo sapiens
DGLQGNSTLAAILGHCVCPGTLEDRAAPRSFQLPHHSVKPSLAPALPPSRDGPPLGFNIPSQPKAVGTWDICFHGQVTSALHGRIWMLTLNWCSESSYGQVTSALHGRIWMLTLNWCSESSYGQVTSALHGRIWMLTLNWCSESSYGQVTSALHGRIWMLTLNWCSESSYGQVTSAFHRRIWTLTLN

SEQ ID NO: 1025789 - protein, 187 aa, Homo sapiens; identical to SEQ ID NO: 1025788

SEQ ID NO: 1025790 - protein, 141 aa, Homo sapiens
MAQHLSTLLLLLATLAVALAWSPKEEDRIIPGGIYNADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 1025791 - protein, 167 aa, Homo sapiens
HGLAPCLGLSPSSPAAPALCSASEETMAQHLSTLLLLLATLAVALAWSPKEEDRIIPGGIYNADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 1025792 - protein, 148 aa, Homo sapiens
HGLAPCLGLSPSSPAAPALCSASEETMAQHLSTLLLLLATLAVALAWSPKEEDRIIPGGIYNADLNDEWVQRALHFAISEYNKATKDDYYRRPLRVLRTICTKSQPNLDTCAFHEQPELQKKQLCSFEIYEVPWENRRSLVKSRCQES

SEQ ID NO: 1025793 - protein, 167 aa, Homo sapiens; identical to SEQ ID NO: 1025791

SEQ ID NO: 1025794 - protein, 167 aa, Homo sapiens; identical to SEQ ID NO: 1025791

SEQ ID NO: 1025795 - protein, 136 aa, Homo sapiens
MDVLVSNERYAGTTKGLLILTFPARQKAQYKVRKSEGAHCPLKPRGLGFRSRETPYPSTRTVLGPQVTAFFEENGQSRPPYRGAEPQARQQSWLVSLHAEATDARERHQTRKDPILNLPSATTRGRPSAQQKPPAR

SEQ ID NO: 1025796 - protein, 202 aa, Homo sapiens
MVDTPLRSIKSETSSNPSSPEICPNKEKPFMKLKENGRAISRSSSSTSSVSSTAGEGEAMEEGDSCGAAKPSTTSPFHAARCYVYSPVPDAAESPKPGGQLPTQIIMTPEFPTGCPKLPDNVPEIEPLKFRFEPSLQPIASLLVRVHYLCTGGVPSALSQGNFPLIRVPVTHVLLVPGRSAPVAVHRRLDHVPSPVAPLAPC

SEQ ID NO: 1025797 - protein, 201 aa, Homo sapiens
MGNLFGRKKQSRVTEQDKAILQLKQQRDKLRQYQKRIAQQLERERALARQLLRDGRKERAKLLLKKKRYQEQLLDRTENQISSLEAMVQSIEFTQIEMKVMEGLQFGNECLNKMHQVMSIEEVERILDETQEAVEYQRQIDELLAGSFTQEDEDAILEELSAITQEQIELPEVPSEPLPEKIPENVPVKARPRQAELVAAS

SEQ ID NO: 1025798 - protein, 224 aa, Homo sapiens
ATVAAGRRWRLDLVGPGPGAGAAMGNLFGRKKQSRVTEQDKAILQLKQQRDKLRQYQKRIAQQLERERALARQLLRDGRKERAKLLLKKKRYQEQLLDRTENQISSLEAMVQSIEFTQIEMKVMEGLQFGNECLNKMHQVMSIEEVERILDETQEAVEYQRQIDELLAGSFTQEDEDAILEELSAITQEQIELPEVPSEPLPEKIPENVPVKARPRQAELVAAS

SEQ ID NO: 1025799 - protein, 224 aa, Homo sapiens; identical to SEQ ID NO: 1025798

SEQ ID NO: 1025800 - protein, 160 aa, Homo sapiens
ATVAAGRRWRLDLVGPGPGAGAAMGNLFGRKKQSRVTEQDKAILQLKQQRDKLRQYQKRIAQQLERERALARQLLRDGRKERAKLLLKKKRYQEQLLDRTENQISSLEAMVQSIEFTQIEMKVMEGLQFGNECLNKMHQVMCPAGPRATSSQDRRLWGMA

SEQ ID NO: 1025801 - protein, 224 aa, Homo sapiens; identical to SEQ ID NO: 1025798

SEQ ID NO: 1025802 - protein, 201 aa, Homo sapiens; identical to SEQ ID NO: 1025797

SEQ ID NO: 1025803 - protein, 289 aa, Homo sapiens
ATVAAGRRWRLDLVGPGPGAGAAMGNLFGRKKQSRVTEQDKAILQLKQQRDKLRQYQKRIAQQLERERALARQLLRDGRKERAKLLLKKKRYQEQLLDRTENQISSLEAMVQSIEFTQIEMKVMEGLQFGNECLNKMHQVMSIEEVERILDETQEAVEYQRQIDELLAGSFTQEDEDAILEELSAITQEQIELPEVPSEPLPEKIPGISMFDSFEWLEFAGEQVDSRREQTECSQAFLCRGRACCLAVWLGGVALLALGLGLGYQGFGNWATSSERPYPFKETHSEIKL

SEQ ID NO: 1025804 - protein, 417 aa, Homo sapiens
KDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVVPGSLVKLRSWFATHFSGHIETVIKKLQNQVLLFKFLRSLS

SEQ ID NO: 1025805 - protein, 214 aa, Homo sapiens
KDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTRELLETLEVEVAVSRDCTIALH

SEQ ID NO: 1025806 - protein, 436 aa, Homo sapiens
KDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKHAYEQIQHNACNPVDDQINVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVVPGSLVKLRSWFATHFSGHIETVIKKLQNQVLLFKFLRSLS

SEQ ID NO: 1025807 - protein, 353 aa, Homo sapiens
MLAARSASGPIVWGGCPLPAKAKGQCNSLSRYPHSVGPQLLSSIQEEMRICWQLKSEQDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVVPGSLVKLRSWFATHFSGHIETVIKKLQNQVLLFKFLRSLS

SEQ ID NO: 1025808 - protein, 136 aa, Homo sapiens
KDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTGIYFLSLNFLLSCI

SEQ ID NO: 1025809 - protein, 189 aa, Homo sapiens
DTTSKLQIPMAARFFTLIYAIKVKLLEVDSVYSDSLDMIVNALANSDLKVQHEGKIVCFCSDDRHRNSVVKAMFSLKSDTKWGRDELVVTLTEFITAAVIQVAKQRLWLFTFATVFRCAQSQELHGNASETMRCHLHRSALAQRLPPCGPLASQAQKPPERCFKDKPRRPAMLMRVFGNRFSKFCQWFV

SEQ ID NO: 1025810 - protein, 67 aa, Homo sapiens
KRAEDEDELGIVGGSHDNLPPPDPRLGRIALNMDTAQDKLPQDLPPLAGGDGTSTVRRPASRSGRSA

SEQ ID NO: 1025811 - protein, 143 aa, Homo sapiens [sequence omitted]

SEQ ID NO: 1025812 - protein, 1206 aa, Homo sapiens [sequence omitted]

SEQ ID NO: 1025813 - protein, 866 aa, Homo sapiens
KQKKVAPRPSIPVKQKPKEKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGGREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDQTPIAFERHQAALTAQGHSSPDKAVMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKVPAVPRVNHKDSSIPKQRRVEGKGSRSSSADKGSSGDTANPFPVPSLPNGNSKPGKPQVKFDKQQADLHMREAKKMKQKAELMTDRVGKAFKYLEAVLSFNECGIATESESQSSKSAYSVYSETVDLIKFIMSLKSFSDATAPTQEKIFAVLCMRCQSILNMAMFRCKKDIAIKYSRTLNKHFESSSKVAQAPSPCIARSTGTPSPLSPMPSPASSVGSQSSAGSVGSSGVAATISTPVTIQIMTSSYVTITSHVLTAFDLWEQAEALTRKNKEFFARLRQMCAPWPSTAVWWTWCTIHDRVFSSYKN

SEQ ID NO: 1025814 - protein, 141 aa, Homo sapiens
MRVEIEYKERYLGPKHALKSHHPINPATSFSNFIITLLSISKDQHRQYQCPNDSPALTASFSRTTLLKIKRIYLEGTGVLGPSLPNKCRILVARTVCSQSSMNSQRWARPASLLSGFSSTMLIIQSTMARLYSKPPWQKRR

SEQ ID NO: 1025815 - protein, 75 aa, Homo sapiens
MGKIALQLKATLENITNLRPWAKDFRWYLKMKCGNGGEISDSWHILLMDSLSLKWRLHWLPWSRSSSSLQVKFSI

SEQ ID NO: 1025816 - protein, 33 aa, Homo sapiens
MAWSGPDPNFAPVPKLGTLEMWLLLTGALSLGD

SEQ ID NO: 1025817 - protein, 33 aa, Homo sapiens; identical to SEQ ID NO: 1025816

SEQ ID NO: 1025818 - protein, 161 aa, Homo sapiens
MSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNAFACFDEEATGTIQEDYLRELLTTMGDRFTDEEVDELYREAPIDKKGNFNYIEFTRI

SEQ ID NO: 1025819 - protein, 161 aa, Homo sapiens; identical to SEQ ID NO: 1025818

SEQ ID NO: 1025820 - protein, 143 aa, Homo sapiens
MSSFAMFDQSQIQEFKEAFNMIDQNRDGFIDKEDLHDMLASLGKNPTDEYLDAMMNEAPGPINFTMFLTMFGEKLNGTDPEDVIRNAFACFDEEATGTIQEDYLRELLTTMGDRFTDEEVDELYREAPIDKKGNFNYIEFTRI

SEQ ID NO: 1025821 - protein, 161 aa, Homo sapiens; identical to SEQ ID NO: 1025818

SEQ ID NO: 1025822 - protein, 173 aa, Homo sapiens
MLGAWRGARILDSEPDLTTTMSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNAFACFDEEATGTIQEDYLRELLTTMGDRFTDEEVDELYREAPIDKDKDD

SEQ ID NO: 1025823 - protein, 161 aa, Homo sapiens; identical to SEQ ID NO: 1025818

SEQ ID NO: 1025824 - protein, 161 aa, Homo sapiens; identical to SEQ ID NO: 1025818

SEQ ID NO: 1025825 - protein, 110 aa, Homo sapiens
PSLTSGWDYRHAPPCQANFVFLVEMGFRHVGQAGLELLTSSDPPSSALQSAGITGMSHHDWPEGASSSWGVGGPCPASATAPCKYQLLGTGEVPGTNANQRKAVWFRLWS

SEQ ID NO: 1025826 - protein, 110 aa, Homo sapiens; identical to SEQ ID NO: 1025825

SEQ ID NO: 1025827 - protein, 110 aa, Homo sapiens; identical to SEQ ID NO: 1025825

SEQ ID NO: 1025828 - protein, 289 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGYKISRMLGPSYSIIERPRMWILRIFEPSPGVGTSELGWDASPGERFSFQPTEMLLRKVPKGTMFLFKDW

SEQ ID NO: 1025829 - protein, 141 aa, Homo sapiens
RAGPFQHIHFRQVLERAAGLDARAEGQGGRLGVQETSWSEGKAAACTSMNKLFSFWKRKNETLSQGYNLRDKGFKGNFTVAASAGHLKKLKEYLQIKKYDVNMQGQKNTRKRFAPRLVLMDHTDVVHYPNLSNNANIDVRG

SEQ ID NO: 1025830 - protein, 176 aa, Homo sapiens
IGSGDIGFLEPLHEENFIHKLKKPLNTVNYTYLEVCYICNPYRSLPIYSPEKVEEYRNRNFYELSPHIFALSDYAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEK

SEQ ID NO: 1025831 - protein, 206 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRGLRPW

SEQ ID NO: 1025832 - protein, 206 aa, Homo sapiens; identical to SEQ ID NO: 1025831

SEQ ID NO: 1025833 - protein, 206 aa, Homo sapiens; identical to SEQ ID NO: 1025831

SEQ ID NO: 1025834 - protein, 206 aa, Homo sapiens; identical to SEQ ID NO: 1025831

SEQ ID NO: 1025835 - protein, 143 aa, Homo sapiens
MSSIASDINVMHCDNIYDEDCCVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRGLRPW

SEQ ID NO: 1025836 - protein, 500 aa, Homo sapiens
EREESMEMGRRIHLELRNRTPSDVKELFLDNSRSNERHTLDRPPQHAIFKQLEFFKSQSNAQAVHLQSRKRYHKFTTNSQAKLELKRITEISGGLEDILHDKVSEPYSTLTFSVATHTYRHISHQSRATDQQVTKYLTAALRTFTNYGDGLTQPCKRTLTTHDMSVKAAIPANSHILDRDYDQGEQDHKCRNHLNTPRTARREHHDEKRDPEHDMTEKEAPNTTKAKQITTDKKAQENKRQRSRRRETPRTARDSTNNVEHKPKTQKNDQKTQQRREDHENTAKRTRTLNTRDRSKTTENRRETQEGSHSDKRAPSTQHSSTPKRGAIRTTTPTTEDERNSQRRNQREEDTAKTGNTQKTKANEKKRQNATDHATTQRTESATRNNKTQRQKETDGGNSEARESETRAERRRENNKDTGRNEQEKGRNGERHTDRNTTRKQRTPQKRQHREREQRRARTRRDERAAKRQNRQARTEAAERKKKQEADSEKSTRREEQEDR

SEQ ID NO: 1025837 - protein, 315 aa, Homo sapiens [sequence omitted]

SEQ ID NO: 1025838 - protein, 125 aa, Homo sapiens [sequence omitted]

SEQ ID NO: 1025839 - protein, 125 aa, Homo sapiens [sequence omitted]

SEQ ID NO: 1025840 - protein, 88 aa, Homo sapiens
VDSRALHIASAYTAPNLKRTHAHEPELFLSRSRPVAAKAKQAHLTTLKHIQAPWWKKLGEESGDEIDVPKDELSIELENLFIGGTKPP

SEQ ID NO: 1025841 - protein, 468 aa, Homo sapiens
LRLKKKMNYYTFSKCDCFSLLALGGHVELIQNVLQSDHFLHLLQADNVQIGSAVMMMLQNILQINRVIYSEVGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSRELQLSMLEIVHPGQVEKHYREMEEKSALNIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 1025842 - protein, 213 aa, Homo sapiens
MEEKSALNIQKHWRGYRERKNFHQQRQSLIEYKAAVTLQRAALKFLAKCRKKKKLFAPWRGLQELTDARRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 1025843 - protein, 450 aa, Homo sapiens
LRLKKKMNYYTFSKCDCFSLLALGGHVELIQNVLQSDHFLHLLQADNVQIGSAVMMMLQNILQINRVIYSEVGRKALYSILDEVIFKLFSTPSPVIRSTATKLLLLMAESHQEILILLRQSTCYKGLRRLLSKQETGTEFSQELRQLVGLLSPMVYQEVEEQKLHQAACLIQAYWKGFQTRKRLKKLPSAVIALQRSFRSKRSKMLLEINRQKEEEDLKLQLQLQRQRAMRLSRELQLSMLEIVHPGQVEKHYREMEEKSALNIQKHWRGYRERKNFHQQRQSLIEYKAAVTLQRAALKFLAKCRKRVELKKRVDDYVRRHLGSPMSDVVSRELHAQAQERLQHYFMGRALEERAQQHREALIAQISTNVEQLMKAPSLKEAEGKEPELFLSRSRPVAAKAKQAHLTTLKHIQAPWWKKLGEESGDEIDVPKDELSIELENLFIGGTKPP

SEQ ID NO: 1025844 - protein, 468 aa, Homo sapiens; identical to SEQ ID NO: 1025841

SEQ ID NO: 1025845 - protein, 227 aa, Homo sapiens
APPEVRVASRDPVPSKPTSPYFKTKMKKVRLKELESRLQQVDGFEKPKLLLEQYPTRPHIAACMLYTIHNTYDDFENKVGGRSKDVVVEYFSIGTGIVLGAGCVCEDFDIDEDALEIFNRNAEEVVEWTKICDIGSHVNVCLLSEADDVPSHSMTVIIESSLVGTREHNEGTDMAFLKTGWGNGKNSSIFPLNKSSSSRKSSSMTWQDHTSITKKKSVDIGSGPNAG

SEQ ID NO: 1025846 - protein, 277 aa, Homo sapiens
RGRGRGCCGRVRLLRRGLHVDCGKLGNKLTSSCGKPSSNRMSLQWTAVATFLYAEVFVVLLLCIPFISPKRWQKIFKSRLVEVLVSYGNTFFVVLSVILVLLVIDAVREIRKYDDVTEKVNLQNNPGAMEHFHMKLFRAQRNLYIAGFSLLLSFLVRRLVTLISQQATLLASNEAFKKQGESASEAAKKYMEENEQLKKGAAVDGGKLDVGNAEVKLEEENRSLKADLQKLKDELASTKQKLEKAENQVLAMRKQFEGLTKEYDRFAGGARKAAGLQ

SEQ ID NO: 1025847 - protein, 313 aa, Homo sapiens
RGRGRGCCGRVRLLRRGLHVDCGKLGNKLTSSCGKPSSNRMSLQWTAVATFLYAEVFVVLLLCIPFISPKRWQKIFKSRLVEVLVSYGNTFFVVLSVILVLLVIDAVREIRKYDDVTEKVNLQNNPGAMEHFHMKLFRAQRNLYIAGFSLLLSFLVRRLVTLISQQATLLASNEAFKKQGESASEAAKKYMEENEQLKKGAAVDGGKLDVGNAEVKLEEENRSLKADLQKLKDELASTKQKLEKAENQVLAMRKQFEGLTKEYHLARACCFLRARPLPPVLLFVPFCFPHSLPQVIARHFGPCPHSPSTLQGT

SEQ ID NO: 1025848 - protein, 225 aa, Homo sapiens
MREVFVVLLLCIPFISPKRWQKIFKSRLVEVLVSYGNTFFVVLSVILVLLVIDAVREIRKYDDVTEKVNLQNNPGAMEHFHMKLFRAQRNLYIAGFSLLLSFLVRRLVTLISQQATLLASNEAFKKQGESASEAAKKYMEENEQLKKGAAVDGGKLDVGNAEVKLEEENRSLKADLQKLKDELASTKQKLEKAENQVLAMRKQFEGLTKEYDRFAGGARKAAGLQ

SEQ ID NO: 1025849 - protein, 114 aa, Homo sapiens
RGRGRGCCGRVRLLRRGLHVDCGKLGNKLTSSCGKPSSNRMSLQWTAVATFLYAGGLCCVASLHSLQFLLKEWQKIFKSRLVEVLVSYGNTFFVVLSVILVLLVIDAVRENSEV

SEQ ID NO: 1025850 - protein, 277 aa, Homo sapiens; identical to SEQ ID NO: 1025846

SEQ ID NO: 1025851 - protein, 260 aa, Homo sapiens
HPPCKALAKDLPKSTDSSLCQEDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMRSGFLP

SEQ ID NO: 1025852 - protein, 263 aa, Homo sapiens
HPPCKALAKDLPKSTDSSLCQEDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVCQLSKNLDEQNDKKKKANENSTPGSWDCTRLLQTHLTGFCVPRLGCVQFNYGTLNNYF

SEQ ID NO: 1025853 - protein, 424 aa, Homo sapiens
HPPCKALAKDLPKSTDSSLCQEDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVDFAFTVWQSFPERIVGYPARSHFWDNSKERWGYTSKWTNDYSMVLTGAAIYHKYYHYLYSHYLPASLKNMVDQLANCEDILMNFLVSAVTKLPPIKVTQKKQYKETMMGQTSRASRWADPDHFAQRQSCMNTFASWFGYMPLIHSQMRLDPVLFKDQVSILRKKYRDIERL

SEQ ID NO: 1025854 - protein, 292 aa, Homo sapiens
HPPCKALAKDLPKSTDSSLCQEDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAMCQLSKNLDEQNDKKKKANENSTPGSWDCTRLLQTHLTGFCVPRLGCVQFNYGTLNNYF

SEQ ID NO: 1025855 - protein, 454 aa, Homo sapiens
HPPCKALAKDLPKSTDSSLCQEDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMSSRFLPYDNIITDAVLSLDEDTVLSTTEVDFAFTVWQSFPERIVGYPARSHFWDNSKERWGYTSKWTNDYSMVLTGAAIYHKYYHYLYSHYLPASLKNMVDQLANCEDILMNFLVSAVTKLPPIKVTQKKQYKETMMGQTSRASRWADPDHFAQRQSCMNTFASWFGYMPLIHSQMRLDPVLFKDQVSILRKKYRDIERL

SEQ ID NO: 1025856 - protein, 381 aa, Homo sapiens
HPPCKALAKDLPKSTDSSLWQEDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMSSRFLPYDNIITDAVLSLDEDTVLSTTEVDFAFTVWQSFPERIVGYPARSHFWDNSLPSADPLISRARLCQLSKNLDEQNDKKKKANENSTPGSWDCTRLLQTHLTGFCVPRLGCVQFNYGTLNNYF

SEQ ID NO: 1025857 - protein, 119 aa, Homo sapiens
MAVLPHIRDPFPLGLWGSLGAKPEGQAPLYPPTLSKRVVPLCTRAGLRLLSTLFIPAEAAGWFSHPRVCRYIDFVLKEDRLKRRLPLPRAEKPLVVGRTQWAIKGRNSMAWPRLKLNLE

SEQ ID NO: 1025858 - protein, 226 aa, Homo sapiens
MAVLPHIRDPFPLGLWGSLGAKPEGQAPLYPPTLSKRVVPLCTRAGLRLLSTLFIPAEAAGWFSHPRVCRYIDFVLKEDRQKKKKKKKKKKPFYSYCLTHATTKNKQQNKTKRTRARYSNPLRSLAADSRTAHDHYLTAGAGPAPKHTSAAAAQNSTASTQHHHPPRPTTSTARRAPETTRHRDTAAQPHRQEPGRTRRSPSSPQDRRGDTRRGRGERNKAAPTPA

SEQ ID NO: 1025859 - protein, 119 aa, Homo sapiens; identical to SEQ ID NO: 1025857

SEQ ID NO: 1025860 - protein, 65 aa, Homo sapiens
MPDDPCPSLAHPAWLYAIEKGLPGLPSPRPTPSRGSGMAVISQRTAKSTKKPKAIEKIESEQQVA

SEQ ID NO: 1025861 - protein, 415 aa, Homo sapiens
PTRPLLMGEMHMVDTVTWHKMRGEHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 1025862 - protein, 434 aa, Homo sapiens
GIPPRMDGQMDRSGRKEAVVLGTEDALPPPLPPPGSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 1025863 - protein, 461 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQTVQGRPLSCRWLQKVARSLALALLCLVLSTCVGPYLFPYFIPLNGDRLLRNKKRKARGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 1025864 - protein, 150 aa, Homo sapiens
EALKDQGLVMAAAPLLYIGIVGDTGRFMYSMDQETFRVVSELFGYDFDYEAVFAPYVNISENAAKLSGYVLQNLTILPSGFAYVVLTKALLEQFDLQDSGTAFVVPLPATIDKVKAWAIFEEQDEGNYRVRLRSRRLSLTNCDQFRVGHP

SEQ ID NO: 1025865 - protein, 254 aa, Homo sapiens [sequence omitted]

SEQ ID NO: 1025866 - protein, 252 aa, Homo sapiens
GRRGSAHASGAAGRLALSGPEAVATAAPELVCAAIGEPMAKWGEGDPRWIVEERADATNVNNWHWTERDASNWSTDKRVETLFRGQCRFKDEEGKCDGDGWMSKVLMEEALHVSNRLTGKLYLLLLNGGVYTKTVTGTLYSQEYKYQGHVEIPSLSDENSVDEAGGLAVSLAKRMSPDTNLVGLMKEEGVKLLREADGNLHQHLRTEFTQGMIFLQMNEEVQVDPRWGISTEKLRSARAKAGPSKTQADLLE

SEQ ID NO: 1025867 - protein, 427 aa, Homo sapiens
QPLPTYDEVLLCTPATTFEEVALLLRRCLTLGSLGHKVYSLLFADQLSYEVARQAEELFHNLCTQQHREDYQLVMVCDGDWEHCYLPSAFSQHKVFVTPQAPLEAIQAYLAGHYRVPKQTLSAAAVFNDRLCVGIVASERAGVGKSLYVKRLHDKMKMQLNVKNVPLKTIRLIDPQVDESRVLGALLPFLDAQYQKVPVLFHLDVTSSVQTGIWVFLFKLLILQYLMDINGKMWLRNPCHLYIVEILERRTSVPSRSSSALRTRVPQFSFLDIFPKVTCRPPKEVIDMELSALRSDTEPGMDLWEFCSETFQRPYQYLRRFNQNQDLDTFQYQEGSVEGTPEECLQHFLFHCGVINPSWSELRNFARFLNYQLRDCEASLFCNPSFIGDTLRGFKKFVVTFMIFMQEILPHHHSTPLSPTSKVVHLE

SEQ ID NO: 1025868 - protein, 288 aa, Homo sapiens [sequence omitted]

SEQ ID NO: 1025869 - protein, 137 aa, Homo sapiens
SGVLADYATLGQALIEATEQAIQVDQVTQDEYVAILEKNDLPHDLAVLFASFQSPIAEDRLMWLQMIYNCFGSRLNAIARCFEGNFVTVKLNGLPVTNHWEFKGQGRHTLICVFFKLSDPSILAYIQLINQRLSSKG

SEQ ID NO: 1025870 - protein, 626 aa, Homo sapiens
MAGERPPLRGPGPGPGEVPGEGPPGPGGTGGGPGRGRPSSYRVLRSAVSSLARVDDFHCAEKIGAGFFSEVYKVRHRQSGQVMVLKMNKLPSNRGNTLREVQLMNRLRHPNILRFMGVCVHQGQLHALTEYMNGGTLEQLLSSPEPLSWPVRLHLALDIARGLRYLHSKGVFHRDLTSKNCLVRREDRGFTAVVGDFGLAEKIPVYREGARKEPLAVVGSPYWMAPEVLRGELYDEKADVFAFGIVLCELIARVPADPDYLPRTEDFGLDVPAFRTLVGDDCPLPFLLLAIHCCNLEPSTRAPFTEITQHLEWILEQLPEPAPLTRTALTHNQGSVARGGPSATLPRPDPRLSRSRSDLFLPPSPESPPNWGDNLTRVNPFSLREDLRGGKIKLLDTPSKPVLPLVPPSPFPSTQLPLVTTPETLVQPGTPARRCRSLPSSPELPRRMETALPGPGPPAVGPSAEEKMECEGSSPEPEPPGPAPQLPLAVATDNFISTCSSASQPWSPRSGPVLNNNPPAVVVNSPQGWAGEPWNRAQHSLPRAAALERTEPSPPPSAPREPDEGLPCPGCCLGPFSFGFLSMCPRPTPAVARYRNLNCEAGSLLCHRGHHAKPPTPSLQLPGARS

SEQ ID NO: 1025871 - protein, 115 aa, Homo sapiens
FSQTLPRIGVPLRGSQPCLPTSYTGAPSTANPNWNKPQCRPPDPSGRNVMGSESPVIEQHWICEGEENSLEPHLGEREPKPKITCHSLKDNCTEDLDLKTPHDSHPSHSTSGILF

SEQ ID NO: 1025872 - protein, 332 aa, Homo sapiens
ADPAQLRRHPGYKRTASATLSDPAAAAMQPSSLLPLALCLLAAPASALVRIPLHKFTSIRRTMSEVGGSVEDLIAKGPVSKYSQAVPAVTEGPIPEVLKNYMDAQYYGEIGIGTPPQCFTIVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRIDNNLPVFDNLLQQKVDQNFSFYLSRDPDAHLGELGGTDSKYKGFSYNFTRKAYWQVHDQVEVASGTLCKEGCEAIDTGTSLMVGPVDEVREQKAIGAVP

SEQ ID NO: 1025873 - protein, 360 aa, Homo sapiens
ADPAQLRRHPGYKRTASATLSDPAAAAMQPSSLLPLALCLLAAPASALVRIPLHKFTSIRRTMSEVGGSVEDLIAKGPVSKYSQAVPAVTEGPIPEVLKNYMDAQYYGEIGIGTPPQCWAPIPEVLKNYMDAQYYGEIGIGTPPQCFTIVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRIDNNLPVFDNLLQQKVDQNFSFYLSRDPDAHLGELGGTDSKYKGFSYNFTRKAYWQVHDQVEVASGTLCKEGCEAIDTGTSLMVGPVDEVREQKAIGAVP

SEQ ID NO: 1025874 - protein, 102 aa, Homo sapiens
IDQEIAQIMNSLDEAAIVTSITGISNRLGSVILAEINHINNFQSPDQLLAFAGLEPSVYQSGQMNATGKIVKRGSTSLRWALCQAAEYASHWSPTLRQYRQK

SEQ ID NO: 1025875 - protein, 117 aa, Homo sapiens
MRLSLPLLLLLLGAWAIPGGLGDRAPLTATAPQLDDEEMYSAHMPAHLRCDACRAVAYQVSPSPLSPCPAHTPSQARPLHPPHIPPPAFDPQSLPLGIKPQMQPFIYSMPQFTHLPA

SEQ ID NO: 1025876 - protein, 189 aa, Homo sapiens
MRLSLPLLLLLLGAWAIPGGLGDRAPLTATAPQLDDEEMYSAHMPAHLRCDACRAVAYQMWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 1025877 - protein, 117 aa, Homo sapiens; identical to SEQ ID NO: 1025875

SEQ ID NO: 1025878 - protein, 117 aa, Homo sapiens; identical to SEQ ID NO: 1025875

SEQ ID NO: 1025879 - protein, 147 aa, Homo sapiens
MVTGGPWPTRLSRTCLHYLGSLEKTRSMKPTNKAEGLWRHCYVGDPRGPAQRRCQPQEKSSSPGLYPPLKEAGACSDGLHSRLQAARRAGSPCSVLPSCLPPPASGHSGLGGSQRLPLWTQIKPSDLTSFLCKRCLWGWECRHWCFC

SEQ ID NO: 1025880 - protein, 112 aa, Homo sapiens
MRRCTQPTCPLTCAVMPAELWLTSYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 1025881 - protein, 130 aa, Homo sapiens
MWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 1025882 - protein, 141 aa, Homo sapiens
MVQVHTCERLHMWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 1025883 - protein, 117 aa, Homo sapiens; identical to SEQ ID NO: 1025875

SEQ ID NO: 1025884 - protein, 117 aa, Homo sapiens; identical to SEQ ID NO: 1025875

SEQ ID NO: 1025885 - protein, 117 aa, Homo sapiens; identical to SEQ ID NO: 1025875

SEQ ID NO: 1025886 - protein, 189 aa, Homo sapiens; identical to SEQ ID NO: 1025876

SEQ ID NO: 1025887 - protein, 130 aa, Homo sapiens; identical to SEQ ID NO: 1025881

SEQ ID NO: 1025888 - protein, 123 aa, Homo sapiens
MRLSLPLLLLLLGAWAIPGGLGDRAPLTATAPQLDDEEMYSAHMPAHLRCDACRAVAYQSLLVPDVAKSGKGRDQTSYLKLWGAAGAERVGLHGCPGPELLPELAGLRSSRSGPSETSHRPRT

SEQ ID NO: 1025889 - protein, 72 aa, Homo sapiens
RELEERISEMAVLAVMHVSPQILDHLTMIDNKNESELEAHLCRMMKHSMDQTGSKSDKETEKGASRIVSGLT

SEQ ID NO: 1025890 - protein, 1272 aa, Homo sapiens
MLNQSAVRIRAGFCLIRLWLLRGLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 1025891 - protein, 1637 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 1025892 - protein, 712 aa, Homo sapiens
MLPMIQYNLMISSKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 1025893 - protein, 1622 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSIQTWILTRLTLQEL

SEQ ID NO: 1025894 - protein, 1660 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 1025895 - protein, 1660 aa, Homo sapiens; identical to SEQ ID NO: 1025894

SEQ ID NO: 1025896 - protein, 151 aa, Homo sapiens
NRDDRYDRGRALVACPLSTRHVPHQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 1025897 - protein, 1388 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTL

SEQ ID NO: 1025898 - protein, 677 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCSRRLSVDEFSVQTCKQLPPLCSV

SEQ ID NO: 1025899 - protein, 378 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSG

SEQ ID NO: 1025900 - protein, 1660 aa, Homo sapiens; identical to SEQ ID NO: 1025894

SEQ ID NO: 1025901 - protein, 961 aa, Homo sapiens
MLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 1025902 - protein, 1642 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 1025903 - protein, 1623 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQLT

SEQ ID NO: 1025904 - protein, 1660 aa, Homo sapiens; identical to SEQ ID NO: 1025894

SEQ ID NO: 1025905 - protein, 1678 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQIDEVLRQEDKAEAMSGHIDQFLIATFMQLRLIYNTHMADEKLEKDEIIKLYSCIIGNMISLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETEKGASRIDEKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKVPVLFFCAVQGGKSTSRSEARLGQQRGWLSLAVRFWKLILDLLEPGLLDNLFSFLKNQMTGVSLTPWFQTSSSKGALPTNCPQKISHAASGAPFTGLP

SEQ ID NO: 1025906 - protein, 1179 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLILNQERVFLHPLVPARIRVPPIPIPVPGGLHQS

SEQ ID NO: 1025907 - protein, 566 aa, Homo sapiens
RRNVKWSSPAGGIDAIFLTTTLQNISEDVLAVMDNKNPTIKQQTSLFIARSFRHCTASTLPKSLLKPFCAALLKHINDSAPEVRDAAFEALGTALKVVGEKALNPFLADVDTLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDRKQKQKALINPSHLVRLLHYHETGFHHRHIGLRLLGSSDPPTLSQSTG

SEQ ID NO: 1025908 - protein, 202 aa, Homo sapiens
MVHKFTRFVNEKRREVPLFFTCGLPALHGDSRVECSKAHPPAHDTYPPTSARLVATCVWGARAPAFSLAVSPDWGTSLLQTPTLACEAELPDKNRSSSASFSNHFVSCLVLDSKLGPSGRYDSMTPESEAEAPQGFVRPLTDPPSHLGSAYPPALREDECLKLMYQELKVPAEEPANVLPMNEIEAWKAAEKKARWVLLVLI

SEQ ID NO: 1025909 - protein, 984 aa, Homo sapiens
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLASGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARALTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRHVTAPPMWIERTSCAEALCGTSRHTRTLHREPWTLPGGWSNFPSRELDPAWLMVDTVIGEGEFGEVYRGTLRLPSQDCKTVAIKTLKDTSPGGQWWNFLREATIMGQFSHPHILHLEGVVTKRKPIMIITEFMENAALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRVTLRLPSLSGSDGIPYRTVSEWLESIRMKRYILHFHSAGLDTMECVLELTAEDLTQMGITLPGHQKRILCSIQGFKD

SEQ ID NO: 1025910 - protein, 146 aa, Homo sapiens
TPTHSPAHCPGAPWKRGPPSPTCCFVLWFSPPEVKKCCRPVCLSICLVGVELIQSTDLFRALEDPPQAWQPSSCILGLPSFPGSPLPGPTRARWVEPLPHTRPSFRALPWKPALPEGPFAQFGPSWVLPPYLFSVPGPLRMRPLKA

SEQ ID NO: 1025911 - protein, 195 aa, Homo sapiens
MGLVSPEAAPFIFPKAFRAPSTRNQMEPQEHGGPLGPAAPFPTSHSKLRPAPLVPWAPLGEPGGATTLLVFVGFSSFPWVSVNACSLVLFSSILVLVGVELIQSTDLFRALEDPPQAWQPSSCILGLPSFPGSPLPGPTRARWVEPLPHTRPSFRALPWKPALPEGPFAQFGPSWVLPPYLFSVPGPLRMRPLKA

SEQ ID NO: 1025912 - protein, 225 aa, Homo sapiens
MRVMAPRTLILLLSGALALTETWAGSHSMRYFSTSVSWPGRGEPRFIAVGYVDDTQFVRFDSDAASPRGEPREPWVEQEGPEYWDRETQKYKRQAQADRVNLRKLRGYYNQSEDGSHTLQRMFGCDLGPDGRLLRGYNQFAYDGKDYIALNEDLRSWTAADTAAQITQRKWEAAREAEQRRAYLEGTCVEWLRRIPGEREGDAAARGTPKDTRGPTIPSLTMRPP

SEQ ID NO: 1025913 - protein, 399 aa, Homo sapiens
GGVSPDVCPALSDEPGGLTASRGRVHEASPPTFQKDALLGSKPNKPSLPSSSQNLGQTEVSKVSETVQEELTPPPQKAAPQGKSKSDPLKKKTDRAPPSPPCDITCLESFRDSMVLGWKQPDKIGGAEITGYYVNYREVIDGVPGKWREANVKAVSEEAYKISNLKENMVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLWEWIDFGYLLLANVTDTDGISIKLLNKIEGRIETF

SEQ ID NO: 1025914 - protein, 319 aa, Homo sapiens
SYSQGSEAIEVKAAIAPPSPPCDITCLESFRDSMVLGWKQPDKIGGAEITGYYVNYREVIDGVPGKWREANVKAVSEEAYKISNLKENMVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLWEWIDFGYLLLANVTDTDGISIKLLNKIEGRIETF

SEQ ID NO: 1025915 - protein, 231 aa, Homo sapiens
MVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLWEWIDFGYLLLANVTDTDGISIKLLNKIEGRIETF

SEQ ID NO: 1025916 - protein, 195 aa, Homo sapiens
FRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 1025917 - protein, 94 aa, Homo sapiens
PTPRPPTPPASTPPWGLTFSLPTICSPSFVLSSLGFTAVAFVTGSLALWAPAFLLRSRVVLGETPPCLPGDSCSSSDRCPDGAMLGGLRVAGLE

SEQ ID NO: 1025918 - protein, 528 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025919 - protein, 605 aa, Homo sapiens
MAERPRGFRSRVAGHVSKACPRGPLPPWLQRDMTGFKQHGGCRGAAPGLSDSKCSGLLPRVGSSVGPERGRARPPGTMAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025920 - protein, 383 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVA

SEQ ID NO: 1025921 - protein, 122 aa, Homo sapiens
LFDAPGTAGSGKVPGYSGDRPAVTMTCEPWRNAQGGFRSRVAGHVSKACPRGPLPPWLQRDMTGFKQHGGCRGAAPGLSDSKCSGLLPRVRGGLRVGSCPLQPAPVPDITCIPHVPSALCVY

SEQ ID NO: 1025922 - protein, 469 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLPAHLPQLALGPPHEGPGPNPLAWPSFQRDPGPCASSQTLHG

SEQ ID NO: 1025923 - protein, 624 aa, Homo sapiens
ANDGVLPRWCMRPGPEGNSAEWSGASTPGEGWPPRGIVPSSARSCPRHHVYSARPLRAVCLLRRGGVTGPGSLLSGALCFRASSPSPGALPSPVFGPSSFLQPPPLAQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025924 - protein, 428 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAGAAPRARCYL

SEQ ID NO: 1025925 - protein, 422 aa, Homo sapiens
LLLAPFLWHTLVLQCTSRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025926 - protein, 132 aa, Homo sapiens [sequence omitted]

SEQ ID NO: 1025927 - protein, 72 aa, Homo sapiens
FVCLSIQLTWALPSPLRPAARSRVHRRPDCGAPAGPLHPRARGQCAHLRGCRSPTCTSATAGPGPTPRRAWA

SEQ ID NO: 1025928 - protein, 539 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVEWALIVAKLVCTEVCCKEKPEQRRMPVEMQSTPDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025929 - protein, 476 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025930 - protein, 455 aa, Homo sapiens
MDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025931 - protein, 565 aa, Homo sapiens
SIALLKLHPSIYPSIHPSFIESKKPANQTLGGRQDGSRELGLLLGFESQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025932 - protein, 311 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALSGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025933 - protein, 360 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLSAAATLQRTEMLE

SEQ ID NO: 1025934 - protein, 376 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNLIFGLITCLTGVLGVGLGVEISRRLRHSNPRADPLVCATGLLGSAPFLFLSLACARGSIVATYIFIFIGETLLSMNWAIVADILLYVVIPTRRSTAGAAPRARCYL

SEQ ID NO: 1025935 - protein, 305 aa, Homo sapiens
LASVEVTVQSVRLLLSVVRSAVSVSHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 1025936 - protein, 133 aa, Homo sapiens
MGSSGEEVGVQEGDPSPQGQPQGLGAICNGIKFVARHQKNDLVFLWVASDLAPRLHPRAPEDCGSFLRALGESLPFWAGRLRWGTALLRVSWLSVTRESHTHALPGACHLASQGLAEGWGLELPLSYPQTCLL

SEQ ID NO: 1025937 - protein, 528 aa, Homo sapiens; identical to SEQ ID NO: 1025918

SEQ ID NO: 1025938 - protein, 342 aa, Homo sapiens [sequence omitted]

SEQ ID NO: 1025939 - protein, 376 aa, Homo sapiens; identical to SEQ ID NO: 1025934

SEQ ID NO: 1025940 - protein, 122 aa, Homo sapiens; identical to SEQ ID NO: 1025921

SEQ ID NO: 1025941 - protein, 194 aa, Homo sapiens
IYNGFTSSATGTLVCELAFGEWSVLYDDVIDTVRNTSECGIVEFYAPWCGHCQRLTPEWKKAATALKDVVKVGAVDADKHHSPREGQNGVQGFPTIKILGSNKNRTRRLPRWQNMGEAIVDAALVLCATREGSAWGEGEDKVLEKEEVISSSKKDVIELTDSFDKNVLDSEDVWMVEFYATWCGHCKNLEPWAA

SEQ ID NO: 1025942 - protein, 70 aa, Homo sapiens
RKDLGMDDLGIYSCDVTDTDGIASSYLIDEEELKRLLALSHEHKFPTVPVKSELAVEILEKAQVRFLDAG

SEQ ID NO: 1025943 - protein, 58 aa, Homo sapiens
LDKANTTTASLPPHLHPNRHINAPHSQTPLTPPLRYRVSRTVTCYGKDEVIEYLVPYT

SEQ ID NO: 1025944 - protein, 90 aa, Homo sapiens
LDKANTTTASLPPHLHPNRHINAPHSQTPLTPPPLAETNHDTHHHHHHGDPNPNTHRHTDPNNDTHQHHHHGDPNPNTHRHTDPKIDTHH

SEQ ID NO: 1025945 - protein, 150 aa, Homo sapiens
TKNRIYTAVSAIGVWYVLYIAYRFLANGRWLRGAMIAIVFVILAYFVVLNIIYYFTNTVVKWDISPKIEKVLGGPQLEEEKAAVHEVIAPANGLYQRQHVMLGEVTVNATQQDNITQLATAFDATRADEDKIMAILVNRHNGNYFTARSD

SEQ ID NO: 1025946 - protein, 358 aa, Homo sapiens [sequence omitted]

SEQ ID NO: 1025947 - protein, 395 aa, Homo sapiens
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEEAAQGYPKMAAGLNATGRPIAFSCSWPAYEGGLPPRVNYSLQADICNLWRNYDDIQDSWRSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKEKSLIEVYMRPLSNKASALVFFSCRTDMPYRYHSSLGQLNFTGSVIYEAQDVYSGDIISGLRDETNFTVIINPSGE

SEQ ID NO: 1025948 - protein, 186 aa, Homo sapiens
TGKKPFKCKECGKGLSSDTALIQHQRIHTGEKPYECKECGKAFSSSSVFLQHQRFHTGEKLYECNECWKTFSCSSSFTVHQRMHTGEKPYECKECGKRLSSITALTQHQRIHTGEKPFECKECGKAFNQKITLISAPASFTLAEKPYGVVKVLWLKPFSWCGKISSGFRNYTLRKTPVPSIGVFLS

SEQ ID NO: 1025949 - protein, 68 aa, Homo sapiens
PTFLNGCGYHVLSRGCRWAVGLDLAAAMDSSSKYGNFERYHQETKVHQKHPENYQVYENGSGSKICPS

SEQ ID NO: 1025950 - protein, 117 aa, Homo sapiens
MAVATMFSRAGVAGLSAWTLQPQWIQVRNMATLKDITRRLKSIKNIQKITKSMKMVAAAKYARAERELKPARIYGLGSLALYEKADIKGPEDKKKHLLIGVSSDRGLGGAIQYPPVC

SEQ ID NO: 1025951 - protein, 54 aa, Homo sapiens
MAVATMFSRAGVAGLSAWTLQPQWIQVIGNRKGPRTRNCRKGKDQILEHCWDLQ

SEQ ID NO: 1025952 - protein, 99 aa, Homo sapiens
LLLFYHCGKLPGNLVVELLENRSYLPQPSCGIPKPKGGKQVCADPSESWVQEYVYDPGTELSCSETGSLQGRSPEPGCFSMSRISSILRTPLRSSCLFS

SEQ ID NO: 1025953 - protein, 102 aa, Homo sapiens
MALLKANKDLISAGLKEFSVLLNQQVFNDPLVSEEDMVTVVEDWMNFYINYYRQQVTGEPQERDKALQELRQELNTLANPFLAKYRDFLKSHELPSHPPPSS

SEQ ID NO: 1025954 - protein, 102 aa, Homo sapiens; identical to SEQ ID NO: 1025953

SEQ ID NO: 1025955 - protein, 126 aa, Homo sapiens
MVELMETTRDTGYNAEERECESWCCGILVFPNPIADHILPCQLPLRNPQVFNDPLVSEEDMVTVVEDWMNFYINYYRQQVTGEPQERDKALQELRQELNTLANPFLAKYRDFLKSHELPSHPPPSS

SEQ ID NO: 1025956 - protein, 134 aa, Homo sapiens
MTPPTSIAWHREIHAPSRVWVRHIQPVRPEGRWLFLRPIRISFPQDLKEFSVLLNQQVFNDPLVSEEDMVTVVEDWMNFYINYYRQQVTGEPQERDKALQELRQELNTLANPFLAKYRDFLKSHELPSHPPPSS

SEQ ID NO: 1025957 - protein, 102 aa, Homo sapiens; identical to SEQ ID NO: 1025953

SEQ ID NO: 1025958 - protein, 102 aa, Homo sapiens; identical to SEQ ID NO: 1025953

SEQ ID NO: 1025959 - protein, 117 aa, Homo sapiens
GRQANNTVRMAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFR

SEQ ID NO: 1025960 - protein, 527 aa, Homo sapiens
MENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 1025961 - protein, 527 aa, Homo sapiens; identical to SEQ ID NO: 1025960

SEQ ID NO: 1025962 - protein, 246 aa, Homo sapiens
NSGGRRRTTSCATSLPSIANAFHQWIQETRTYLLDGSCMVEESGTLRDPSLEATKSQCTMEIRAMMKSVSTKRSTVPGGRHGGGPHPGLQVHGAQLRGPLPSHVATYAWNTAWCRCLLCQHNPGCSRSRPGTQHGVTEEARQMNSDDVLDTLHKDKSGRLDPSGVQILPVLPWGYELPYGGDTGEADPEFEAILDTVDPNRDGHVSLQEYMAFMISRETENAKSSEEIESAFRALSSEGKPYVTKE

SEQ ID NO: 1025963 - protein, 95 aa, Homo sapiens
MANRGPAYGLSREVQQKIEKQYDADLEQILIQWITTQCRKDVGRPQPGRENFQNWLMDGTVLCELINALYPRRVQAPSKEEPGDQGQAEGAGPGR

SEQ ID NO: 1025964 - protein, 250 aa, Homo sapiens
LACDSVRSSASALIVTLHRDCTWHVLLDVLPGDLTFVLKLGMCLPFMVPLLDECIASSFDRVSCIPFAVTRREMLKADFEAHLGSCSADNSPETLVQTNEQRMTLVVTSSSSIAAWYASMCAQVPEVEEDPGLHHGLQAEWSRSLSFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 1025965 - protein, 249 aa, Homo sapiens
LALALSQSCSSSPLERSPQPPPPIGMANRGPAYGLSREVQQKIEKQYDADLEQILIQWITTQCRKDVGRPQPGRENFQNWLMDGTVLCELINALYPRRVQAPSKRQIQASTMAFKQNGADLSVSCKQLSAMAFTNPLDHSSQNLWNPHRHREQRNHCPCVHAGTAHIDSMGLAWKDAPEIDWGSSTLWGTSPIFGFPSKAHITKAESLTRNFSDNQLQEGKNVIGLQMGTNRGASQAGMTGYGMPRQIL

SEQ ID NO: 1025966 - protein, 202 aa, Homo sapiens
MANRGPAYGLSREVQQKIEKQYDADLEQILIQWITTQCRKDVGRPQPGRENFQNWLMDGTVLCELINALYPRRVQAPSKRQIQASTMAFKPEWSRSLSFLQAAERYGINTTDIFQTVDLWEGKNMACVQRTLMNLGGLAVARDDGLFSGDPNWFPKKSKENPRNFSDNQLQEGKNVIGLQMGTNRGASQAGMTGYGMPRQIL

SEQ ID NO: 1025967 - protein, 202 aa, Homo sapiens; identical to SEQ ID NO: 1025966

SEQ ID NO: 1025968 - protein, 152 aa, Homo sapiens
RVGGLRVCFGDRKGIIMEHLEGVINKPEAEMSPQELQLHYFKMHDYDGNNLLDGLELSTAITHVHKEEGSEQAPLMSEDELINIIDGVLRDDDNNNDGYIDYAEFANITAVDVIWPSPGLYTNVTRDNVIEHFSYMQINSFQLLLQHFGKNL

SEQ ID NO: 1025969 - protein, 338 aa, Homo sapiens
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARSKLLQPRVVPPMVGGPPFVGPVGFGPGDRSHLDSPEAREAMFLRRAAAGRPPYGPTAPSPGPRGPPLPGPPGPPMMLPPMARAPGPPLGSMAALRPPLEEPAAPRELGLGLGLGLKEKEEAVVAAAAGLEEASAAVAVGGRRCPSWPCSHWGQFLPLALAIAIARSLSPRALSRWEVGPAGLLRHTLLHSVNIRVPWCSHRVPETRLGDEKPMRPLGVLQFGFLWMGPPGVPHLGG

SEQ ID NO: 1025970 - protein, 222 aa, Homo sapiens
MAGAGPAPGLPGAGGPVVPGPGAGIPGKSGEERLKEMEAEMALFEQEVLGAPVPGIPTAVPAVPTVPTVPTVEASMAALRPPLEEPAAPRELGLGLGLGLKEKEEAVVAAAAGLEEASAAVAVGGRRCPSWPCSHWGQFLPLALAIAICLGALSPRALSRWEVGPAGLLRHTLLHSVNIRVPWCSHRVPETRLGDEKPMRPLGVLQFGFLWMGPPGVPHLGG

SEQ ID NO: 1025971 - protein, 192 aa, Homo sapiens
MAGAGPAPGLPGAGGPVVPGPGAGIPGKSGEERLKEMEAEMALFEQEVLGAPVPGIPTAVPAVPTVPTVPTVEAMQVPAAPVIRPIIATNTYQQVQQTLEARSKLLQPRVVPPMVGGPPFVGPVGFGPGDRSHLDSPEAREAMFLRRAAVAPRGPYPASAFVPHVLQRADSVSPLQRRSSVAGPTGWGGPCV

SEQ ID NO: 1025972 - protein, 139 aa, Homo sapiens
PVFLSRLCDVLLGWFFSGALCLLAGLAFAFVFCRCGVGVRPSLGACAVRGCFLVVGGWLFLWGLPALPPPSFFLPPFFPPSSPPLLLFPPPPGSLWAVWGVGPVRRRLTAGPWRRAGRASEAAWRTCCGCRRSPTCQSG

SEQ ID NO: 1025973 - protein, 133 aa, Homo sapiens
YHTIFHTAHVRCQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 1025974 - protein, 446 aa, Homo sapiens
DALICTDDFIAKVVQRCMSIPVTMRAIRRKAETIQADTPALSLIAETVEDMVKKNLPPASSPGYGMTTGNNPMSGTTTPTNTFPGGPITTLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDGPAMGTPLRDSSSSGHSQSTLYDSDVFQTNNNENPYTDPADLIADAAGSPSSDSPTKSFFLMHGVDFNPDLLNSQSQSGLEKEYFDEKQQSGDNDDFHRICLPRPLILWGCQCCQGTPGTPVQGNTKRKVI

SEQ ID NO: 1025975 - protein, 440 aa, Homo sapiens
SRGSRAPSGCILPGCASGSRWSRKAETIQADTPALSLIAETVEDMVKKNLPPASSPGYGMTTGNNPMSGTTTPTNTFPGGPITTLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDGPAMGTPLRDSSSSGHSQSTLYDSDVFQTNNNENPYTDPADLIADAAGSPSSDSPTKSFFLMHGVDFNPDLLNSQSQSGLEKEYFDEKQQSGDNDDFHRICLPRPLILWGCQCCQGTPGTPVQGNTKRKVI

SEQ ID NO: 1025976 - protein, 364 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSHEGPGGPSSSEAWANLAGRRGWGHGSQGGTTKESQRERTKAEKQEDNKPEMIKNHQGAHKGRQQRKTTIMVTIQNDCEHTRREQTEHRDTMIKATDTHPRELLD

SEQ ID NO: 1025977 - protein, 136 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPERPVWALALGV

SEQ ID NO: 1025978 - protein, 537 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPAVVLQHISVLQTTHLPDGGVRLLEKSGGLEIIFDVYQADAVATFRKNNPGKPYARMCISGFDEPVPDLCSLKRLSYQSGDVPLIFALVDHGDISFYSFRDFTLPQDVGH

SEQ ID NO: 1025979 - protein, 537 aa, Homo sapiens; identical to SEQ ID NO: 1025978

SEQ ID NO: 1025980 - protein, 573 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPGTPSACHIFEGHWQLRNHRTLERAWMNWDGLRLKEDVGGGSGPTSTVSSPAAAAGPVWEGLEKPWSFSISLCCRQHTFLMEVSGCWRSLGAWKSSLMFTRPTLWPHSERITLANPMPGCALVDLMSLSQTSAASSGCLTRVGMSL

SEQ ID NO: 1025981 - protein, 477 aa, Homo sapiens
MAPPSGRHQCGDPSLEEALVPGGGGASAPSWAGQRLPPPALETWLLEPSRRDRTEDTKEWQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPAVVLQHISVLQTTHLPDGGVRLLEKSGGLEIIFDVYQADAVATFRKNNPGKPYARMCISGFDEPVPDLCSLKRLSYQSGDVPLIFALVDHGDISFYSFRDFTLPQDVGH

SEQ ID NO: 1025982 - protein, 473 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEAQPWPGQGGGGVQLGEWQSRERSQGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPGTPSACHIFEGHWQLRNHRTLERAWMNWDGLRLKEDVGGGSGPTSTVSSPAAAAGPVWEGLEMVSQER

SEQ ID NO: 1025983 - protein, 555 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPRSPGRGGGSVAHPLFSPHSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPAVVLQHISVLQTTHLPDGGVRLLEKSGGLEIIFDVYQADAVATFRKNNPGKPYARMCISGFDEPVPDLCSLKRLSYQSGDVPLIFALVDHGDISFYSFRDFTLPQDVGH

SEQ ID NO: 1025984 - protein, 255 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEGV

SEQ ID NO: 1025985 - protein, 512 aa, Homo sapiens
WRRAQRQAAAGWSPIPSPRPWRFPRGACSVCVRWPWPGVGVWGAAGGQRWVGKPGCPGTLARLAPDALAADPCVPFSPSATESIYSRPHRGIDRTHAPSRLAVDPKALSCHRTSSEQLQGQSGMTGPCCQGKDASAQPALAGRHAGCRKLAMSDMTIGELARRWEAQGQEGSFRGHVRDVIQQDGEQNLHGAESKLVRSPTTDGEGTRDTKTVSAHRAKKGAYAYSFLGRWCGIPSHRTFHIPSPKRNQLPHLLIIISQGGQGIYAKDSCYCNCNHRNPNKRKYETQLYPYWTRVTQNRDTYTATSTLERGTGSRGEQARLRNTAPKRYPQQTTKPSIEPMNPSERLERSASSHTHTDKPKEGEQHTGAADMARTRGASKRTKRSGTHTPTQHTRRKHRAAERADRQEKTHRTQETKRAGGRQAEDKREGQQGSTKAEKHKAQERDSDPGEAARTHRNDRGQGEEQRSTPDTKVRQTKEQRDKQSNSDRRQQQGNETERDKTKKARRDRPRK

SEQ ID NO: 1025986 - protein, 149 aa, Homo sapiens
MAPPSGRHQCGDPSLEEALVPGGGGASAPSWAGQRLPPPALETWLLEPSRRDRTEDTEGMANLPGPLLTVPGWPSACKVGICTPSARPSLSPSALLAQPGRCGTKQREAAEGRYKCDHSHCTPDAGSSGFTGEKPRGGLGAKEGPSASP

SEQ ID NO: 1025987 - protein, 496 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPGTPSACHIFEGHWQLRNHRTLERAWMNWDGLRLKEDVGGGSGPTSTVSSPAAAAGPVWEGLEMVSQER

SEQ ID NO: 1025988 - protein, 433 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPDNTPS

SEQ ID NO: 1025989 - protein, 568 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAVSGGLVGPGTALPALPVPPSLVTLALGPTLRCKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPAVVLQHISVLQTTHLPDGGVRLLEKSGGLEIIFDVYQADAVATFRKNNPGKPYARMCISGFDEPVPDLCSLKRLSYQSGDVPLIFALVDHGDISFYSFRDFTLPQDVGH

SEQ ID NO: 1025990 - protein, 561 aa, Homo sapiens
VAARAAAGGGGMEPDPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPLVTPTSRWPPRECWCLGPWKMHRLSKNQQLPCRLRETLGDLPSAPMGRVHLSNPGQMCCFSPTSLRSINKKAKALDNSLQPKSLAASSPPPCSQPSQCPEEKPQESSPMKGPGGPFQLLGSLGPSPGPAREGVGCSWESGRAENGVTGAGKRRWNFEQISFPNMASDSRHTLLRAPAPELLPANVAGRETDAESWCQKLNQRKENLSRREREHHAEAAQFQEDVNADPEVQRCSSWREYKELLQRRQVQRSQRRAPHLWGQPVTPLLSPGQASSPGTPSACHIFEGHWQLRNHRTLERAWMNWDGLRLKEDVGGGSGPTSTVSSPAAAAGPVWEGLEMVSQER

SEQ ID NO: 1025991 - protein, 323 aa, Homo sapiens [sequence omitted]

SEQ ID NO: 1025992 - protein, 276 aa, Homo sapiens [sequence omitted]

SEQ ID NO: 1025993 - protein, 221 aa, Homo sapiens
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 1025994 - protein, 112 aa, Homo sapiens
MRGLHPWHVLRRPLGPQAHANDPECGQRPVPALSHHGSQAKVIQTKSTQCLSYPLTIATLLTSASWCLYGFRLRDPYIMVSNFPGIVTSFIRFWLFWKYPQEQDRNYWLLQT

SEQ ID NO: 1025995 - protein, 241 aa, Homo sapiens
ESRGLGCSRSRQPQARGGRWARDPTLVVMEAGGFLDSLIYGACVVFTSDLRHMRMTRSVDNVQFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 1025996 - protein, 221 aa, Homo sapiens; identical to SEQ ID NO: 1025993

SEQ ID NO: 1025997 - protein, 103 aa, Homo sapiens
MIQRLGPQAHANDPECGQRPVPALSHHGSQAKVIQTKSTQCLSYPLTIATLLTSASWCLYGFRLRDPYIMVSNFPGIVTSFIRFWLFWKYPQEQDRNYWLLQT

SEQ ID NO: 1025998 - protein, 206 aa, Homo sapiens
MSETTVSHIKIHVCKGPLGGPPLTLNPFEPCPSPPPCSNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 1025999 - protein, 215 aa, Homo sapiens
RAAGLGCSRSRQPQARGGRWARDPTLVVMEAGGFLDSLIYGACVVFTNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 1026000 - protein, 206 aa, Homo sapiens; identical to SEQ ID NO: 1025998

SEQ ID NO: 1026001 - protein, 221 aa, Homo sapiens; identical to SEQ ID NO: 1025993

SEQ ID NO: 1026002 - protein, 158 aa, Homo sapiens
MRGLHLGPQAHANDPECGQRPVPALSHHGSQRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 1026003 - protein, 167 aa, Homo sapiens
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKAKVIQTKSTQCLSYPLTIATLLTSASWCLYGFRLRDPYIMVSNFPGIVTSFIRFWLFWKYPQEQDRNYWLLQT

SEQ ID NO: 1026004 - protein, 179 aa, Homo sapiens [sequence omitted]

SEQ ID NO: 1026005 - protein, 221 aa, Homo sapiens; identical to SEQ ID NO: 1025993

SEQ ID NO: 1026006 - protein, 156 aa, Homo sapiens
MEELGPQAHANDPECGQRPVPALSHHGSQRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 1026007 - protein, 221 aa, Homo sapiens; identical to SEQ ID NO: 1025993

SEQ ID NO: 1026008 - protein, 110 aa, Homo sapiens
KSKKNGRAQIELAVIIIRSRTNDFARPELIKPGYPTNLLIGVLDFHTQDITRLNVGFTIEINRAVDFRCICHAATNRAFFVHFVDNHQNFTAHFLLQALGGNLLLQLHET

SEQ ID NO: 1026009 - protein, 360 aa, Homo sapiens
SSRRELRLCNLMGAKMAMEMRLPVARKPLSERLGRDTKKHLVVPGDTITTDTGFMRGHGTYMGEEKLIASVAGSVERVNKLICVKALKTRYIGEVGDIVLGRITEVQQKRWKVETNSRLDSVLLLSSMNLPGGELRRRSAEDELAMRGFLQEGDLISAEVQAAFSDGSCLFATRGDLKYGKLGHGGRGTRFPASLVKRQKTHCHDVAMWCLSDSLVTTASSGLPKPEHKRTRKQEGLIARLEPGSLLMRGDYPDSERDHLRRYTQRTTQHDTQDIRDGTKDPSHIRRSTRKPEIREERGREHDPGTGKHRDKAGTKNTAHDLQKQTRKNPTLRTRDENPDPAAETHNTSNPTDHERPTKR

SEQ ID NO: 1026010 - protein, 77 aa, Homo sapiens
AASVLSAALLAPGGSSGRDAQAAPPRDLDKKRHAELKMDQALLLIHNELLWTNLTVYWKSECCYHCITLLLDQRRKE

SEQ ID NO: 1026011 - protein, 80 aa, Homo sapiens
AASVLSAALLAPGGSSGRDAQAAPPRDLDKKRHAELKMDQALLLIHNELLWTNLTVYWKSECCYHVCISSHSVLFALGLV

SEQ ID NO: 1026012 - protein, 184 aa, Homo sapiens
FENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTAGEKTFYDKGTLKIHYNAVHLKIKHKCTIEGCNMVFSSLRSRNRHSANPNPRLHMP

SEQ ID NO: 1026013 - protein, 98 aa, Homo sapiens
MRDNWVITWAPYPPLSNSYNVLLPEVVIFCAVMILVNTMVIAWSSSTVTNAGPKPAMACSGATVACCQGWWALVTGFVVGWFISNQRIALAIKIIGIK

SEQ ID NO: 1026014 - protein, 183 aa, Homo sapiens
AIELALKVIGLQEAEGVLLLKAQAPGSKPQSPLKNGGPYHMWGQPLQRAKGNKAPVSSATTSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 1026015 - protein, 196 aa, Homo sapiens
AIELALKVIGLQEAEGVLLLKAQAPGSKPQSPLKNGGPYHMWGQPLQRAKGNKAPVSSATTSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPRLRAPQRGRGCLGYRVVVP

SEQ ID NO: 1026016 - protein, 183 aa, Homo sapiens; identical to SEQ ID NO: 1026014

SEQ ID NO: 1026017 - protein, 183 aa, Homo sapiens; identical to SEQ ID NO: 1026014

SEQ ID NO: 1026018 - protein, 183 aa, Homo sapiens; identical to SEQ ID NO: 1026014

SEQ ID NO: 1026019 - protein, 112 aa, Homo sapiens
MEKTELIQKAKLAEQAERYDDMATVHERQRPSRAPRLSNEERNLLSGGLHENVWSGAAGSAWRVISSIRDRKTDNSEQKLQADYRTIRERQLDCPEAEDPLLRPPVSGNWSG

SEQ ID NO: 1026020 - protein, 466 aa, Homo sapiens
ERAGGLYPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYEGHHKTVPRPQGQGNFICGERSQWWRGRGPVWPIAHARREQRSVAHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTGNLRPGIRRTRHLIGEAVFARCLSSSERMREFKLARKLRGPQKFQLDGDKKSFLEDIRTGHSTASKIISYAQGFYAAKGRQPPRFGWTLKYGGIALMWRGGCIIRSVSLGKIQDAYDRKPELQRLLLDDFFKSAVEHCQDSWRRGSQHWGPGWHSHDLVSALALSFYDGYRPEM

SEQ ID NO: 1026021 - protein, 443 aa, Homo sapiens
ERLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLRRCRDLKAKGILFVGSGVSGGEEGARYGPSLMPGGNKEAWPTSRPSSKALLQKWELENPAVTGWEMREQATFVKMVHNGIEYGDMQLICEAYHLMKDVLGMAQDEMAQAFEDWNKTELDSFLIEITANILKFQDTDGKHLLPKIRDSAGQKGTGKWTGNLRPGIRRTRHLIGEAVFARCLSSSERMREFKLARKLRGPQKFQLDGDKKSFLEDIRTGHSTASKIISYAQGFYAAKGRQPPRFGWTLKYGGIALMWRGGCIIRSVSLGKIQDAYDRKPELQRLLLDDFFKSAVEHCQDSWRRGSQHWGPGWHSHDLVSALALSFYDGYRPEM

SEQ ID NO: 1026022 - protein, 348 aa, Homo sapiens
MNGTEGPNFYVPFSNVTGVVRSPFEQPQYYLAEPWQFSMLAAYMFLLIVLGFPINFLTLYVTVQHKKLRTPLNYILLNLAVADLFMVFGGFTTTLYTSLHGYFVFGPTGCNLEGFFATLGGEIALWSLVVLAIERYVVVCKPMSNFRFGENHAIMGVVFTWIMALACAAPPLVGWSRYIPEGMQCSCGIDYYTLKPEVNNESFVIYMFVVHFTIPMIVIFFCYGQLVFTVKEAAAQQQESATTQKAEKEVTRMVIIMVIFFLICWLPYASVAFYIFTHQGSNFGPIFMTLPAFFAKSSSIYNPVIYIMLNKQFRNCMLTTLCCGKNPLGDDDASATASKTETSQVAPA

SEQ ID NO: 1026023 - protein, 348 aa, Homo sapiens; identical to SEQ ID NO: 1026022

SEQ ID NO: 1026024 - protein, 361 aa, Homo sapiens
PPLPPYWCYQIEVDIVGTEGPNFYVPFSNVTGVVRSPFEQPQYYLAEPWQFSMLAAYMFLLIVLGFPINFLTLYVTVQHKKLRTPLNYILLNLAVADLFMVFGGFTTTLYTSLHGYFVFGPTGCNLEGFFATLGGEIALWSLVVLAIERYVVVCKPMSNFRFGENHAIMGVVFTWIMALACAAPPLVGWSRYIPEGMQCSCGIDYYTLKPEVNNESFVIYMFVVHFTIPMIVIFFCYGQLVFTVKEAVPSSRSSTTQKAEKEVTRMVIIMVIFFLICWLPYASVAFYIFTHQGSNFGPIFMTLPAFFAKSSSIYNPVIYIMLNKQFRNCMLTTLCCGKNPLGDDDASATASKTETSQVAPA

SEQ ID NO: 1026025 - protein, 229 aa, Homo sapiens [sequence omitted]

SEQ ID NO: 1026026 - protein, 133 aa, Homo sapiens
SQRNNEHARSDETELILEIEDSAKMGDVSYGYSYWYLSHTVMSGDSERRYLDLSLLLRCEVYLCDTMNEKCKPTCSGTRFRSGSVIDQSRVLNLGPITRKGVQATVSRAFSSLGLLKVWLPLLLSATLTLTFQ

SEQ ID NO: 1026027 - protein, 436 aa, Homo sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTVRPGQWGTEPEHCLVQVSALSLPSYRSFGELFSLAVPQFHQL

SEQ ID NO: 1026028 - protein, 228 aa, Homo sapiens
TWRKKSAHCKLLAGTSPGLAVSWSNVAPSSACALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 1026029 - protein, 640 aa, Homo sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 1026030 - protein, 448 aa, Homo sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVKMPTH

SEQ ID NO: 1026031 - protein, 640 aa, Homo sapiens
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLDCEVYLCDTMNEKCKPTCSGTRFRSGSVIDQSRVLNLGPITRKGVQATVSRAFSSLGLLKVWLPLLLSATLTLTFQ

SEQ ID NO: 1026032 - protein, 313 aa, Homo sapiens
MGQPSLTWMLMVVVASWFITTAATDTSEARWCSECHSNATCTEDEAVTTCTCQEGFTGDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 1026033 - protein, 793 aa, Homo sapiens
KPQLELRPQTSMQGEESLRILVEPEGDSFPLMEISTCETEASEQWDYVLVAQRHTQRDPRQARQQQFLEELRRKGFHIKVIRDQKQVFFGIRADNSVFGLYRTLLLEPEGPAPHAELAAPTTIPVTTSLRIRIVNFVVMNNKTSAGETFEDLMKDGVFEARFPLHKGEGRLKKTWARWRHMFREQPVDEIRNYFGEKVALYFVWLGWYTYMLVPAALTGLLVFLSGFSLFEASQISKEICEAHDILMCPLGDHSRRYQRLSETCTFAKLTHLFDNDGTVVFAIFMALWATVFLEIWKRQRARVVLHWDLYVWDEEQEEMALQLINCPDYKLRPYQHSYLRSTVILVLTLLMICLMIGMAHVLVVYRVLASALFSSSAVPFLEEQVTTAVVVTGALVHYVTIVIMTKINRRVALKLCDFEMPRTFSERESRFTIRFFTLQFFTHFSSLIYIAFILGRINGHPGKSTRLAGLWKLEECHASGCMMDLFVQMAIIMGLKQTLSNCVEYLVPWVTHKCRSLRASESGHLPRDPELRDWRRNYLLNPVNTFSLFDEFMEMMIQYGFTTIFVAAFPLAPLLALFSNLVEIRLDAIKMVWLQRRLVPRKAKDIGTWLQVLETIGVLAVIANGMVIAFTSEFIPRVVYKYRYSPCLKEGNSTVDCLKGYVNHSLSVFHTKDFQDPDGIEGSENVTLCRYRDYRNPPDYNFSEQFWFLLAIRLAFVILFEHVALCIKLIAAWFVPDIPQSVKNKVLEVKYQRLREKMWHGRQRLGGVGAGSRPPMPAHPTPASIFSARSTDV

SEQ ID NO: 1026034 - protein, 58 aa, Homo sapiens
TQCSCILQVTQDPLAYGKAKELCKAADMVQDIRGEDEPRDEIEKATYGVVPYLALPYD

SEQ ID NO: 1026035 - protein, 168 aa, Homo sapiens [sequence omitted]

SEQ ID NO: 1026036 - protein, 98 aa, Homo sapiens
RPEQGLLAPDALHGPHMPAVSEEEMALQLINCVQRPPGAETVPPPAPPTSPPLCVLRGAVRRLCPCGAAGIPCMFRAVSCHPIPPAPSLWGLSGLAQP

SEQ ID NO: 1026037 - protein, 78 aa, Homo sapiens
AIMILDWIIVISNVFLKSLKPERLEPDQYTEVLTWKTPWVHPARCAHTPPQHVGESTGTMRRPRAPLSGAGWGEEVSP

SEQ ID NO: 1026038 - protein, 126 aa, Homo sapiens
MPACILTGLLSAAGGAGSSGVESPWEVTPEGLDPRSSNLHVSWRVPLAKEEELWDWRPCSSGCLGAWGGFGDLSSFCRGDLQVTVWMLCCVFGPCRVLSPLPTCAERGWCFPKFLEGASSSALLAS

SEQ ID NO: 1026039 - protein, 77 aa, Homo sapiens
TQCSCILQVTQDPLAYGKAKELCKAADMVQDIRGPSGVEETKMKEDEPRDEIEKATYGVVPLRRYLALPYASMQALP

SEQ ID NO: 1026040 - protein, 30 aa, Homo sapiens
MARPRSEDEPRDEIEKATYGVVPYLALPYD

SEQ ID NO: 1026041 - protein, 825 aa, Homo sapiens
KPQLELRPQTSMQGEESLRILVEPEGDSFPLMEISTCETEASEQWDYVLVAQRHTQRDPRQARQQQFLEELRRKGFHIKVIRDQKQVFFGIRADNSVFGLYRTLLLEPEGPAPHAELAAPTTIPVTTSLRIRIVNFVVMNNKTSAGETFEDLMKDGVFEARFPLHKGEGRLKKTWARWRHMFREQPVDEIRNYFGEKVALYFVWLGWYTYMLVPAALTGLLVFLSGFSLFEASQISKEICEAHDILMCPLGDHSRRYQRLSETCTFAKLTHLFDNDGTVVFAIFMALWATVFLEIWKRQRARVVLHWDLYVWDEEQVRWSWQRSSGRPEQGLLAPDALHGPHMPAVSEEEMALQLINCPDYKLRPYQHSYLRSTVILVLTLLMICLMIGMAHVLVVYRVLASALFSSSAVPFLEEQVTTAVVVTGALVHYVTIVIMTKINRRVALKLCDFEMPRTFSERESRFTIRFFTLQFFTHFSSLIYIAFILGRINGHPGKSTRLAGLWKLEECHASGCMMDLFVQMAIIMGLKQTLSNCVEYLVPWVTHKCRSLRASESGHLPRDPELRDWRRNYLLNPVNTFSLFDEFMEMMIQYGFTTIFVAAFPLAPLLALFSNLVEIRLDAIKMVWLQRRLVPRKAKDIGTWLQVLETIGVLAVIANGMVIAFTSEFIPRVVYKYRYSPCLKEGNSTVDCLKGYVNHSLSVFHTKDFQDPDGIEGSENVTLCRYRDYRNPPDYNFSEQFWFLLAIRLAFVILFEHVALCIKLIAAWFVPDIPQSVKNKVLEVKYQRLREKMWHGRQRLGGVGAGSRPPMPAHPTPASIFSARSTDV

SEQ ID NO: 1026042 - protein, 173 aa, Homo sapiens
MVIAFTSEFIPRVVYKYRYSPCLKEGNSTVDCLKGYVNHSLSVFHTKDFQDPDGIEGSENVTLCRYRDYRNPPDYNFSEQFWFLLAIRLAFVILFEVSQNRERPRSGSGQCSPQSFSPALKPPNASWHLTVLGLSCAALARGLVHQAHRRLVRARHPSVGEEQGSGGEVPEAA

SEQ ID NO: 1026043 - protein, 853 aa, Homo sapiens
KPQLELRPQTSMQGEESLRILVEPEGDSFPLMEISTCETEASEQWDYVLVAQRHTQRDPRQARQQQFLEELRRKGFHIKVIRDQKQVFFGIRADNSVFGLYRTLLLEPEGPAPHAELAAPTTIPVTTSLRIRIVNFVVMNNKTSAGETFEDLMKDGVFEARFPLHKGEGRLKKTWARWRHMFREQPVDEIRNYFGEKVALYFVWLGWYTYMLVPAALTGLLVFLSGFSLFEASQISKEICEAHDILMCPLGDHSRRYQRLSETCTFAKLTHLFDNDGTVVFAIFMALWATVFLEIWKRQRARVVLHWDLYVWDEEQVRWSWQRSSGRPEQGLLAPDALHGPHMPAVSEEEMALQLINCPDYKLRPYQHSYLRSTVILVLTLLMICLMIGMAHVLVVYRVLASALFSSSAVPFLEEQVTTAVVVTGALVHYVTIVIMTKINRRVALKLCDFEMPRTFSERESRFTIRFFTLQFFTHFSSLIYIAFILGRINGHPGKSTRLAGLWKLEECHASGCMMDLFVQMAIIMGLKQTLSNCVEYLVPWVTHKCRSLRASESGHLPRDPELRDWRRNYLLNPVNTFSLFDEFMEMMIQYGFTTIFVAAFPLAPLLALFSNLVEIRLDAIKMVWLQRRLVPRKAKDIGQTGRAQDGRELGGLRPVGFPLARPAHLEKIISRISGRRQPPALLRRPRMRVEPGWEGTRSGRGRALCRLLPQTVRSSEALQLAPKGDPGSASGWGWNRAAGLCPKTGHAETDRQQGSDGSWGAGCGERERGVREAPSLGPRLQGLTLGWEPRRWSGLGAQLRSSGRWRMRIPRFLPVHVRLRGAGAQEAMLCHGWGLPSVNTASLGLQGDNTHR

SEQ ID NO: 1026044 - protein, 227 aa, Homo sapiens
MGPVLREAFSQQGRLSSIWEPALQLPACLGCCLHPWGGNACLHLDGPPVGCWRSWELSMTRECSVSLKNCGRRLQERKEPRFLQGRGSVGRGRPGVSVGSGRVLTLFKLRLLPLRQDEDSGVESPWEVTPEGLDPRSSNLHVSWRVPLAKEEELWDWRPCSSGCLGAWGGFGDLSSFCRGDLQVTVWMLCCVFGPCRVLSPLPTCAERGWCFPKFLEGASSSALLAS

SEQ ID NO: 1026045 - protein, 60 aa, Homo sapiens
VPIAYGKAKELCKAADMVQDIKMNHEDEPRDEIEKATYGVVPLRRYLALPYATMQALPKY

SEQ ID NO: 1026046 - protein, 79 aa, Homo sapiens
VPIAYGKAKELCKAADMVQDIKMNHSEVVPYGKALPYAFAYGKARSEDEPRDEIEKATYGVVPLRRYLALPYASMQALP

SEQ ID NO: 1026047 - protein, 173 aa, Homo sapiens; identical to SEQ ID NO: 1026042

SEQ ID NO: 1026048 - protein, 136 aa, Homo sapiens
MPACILTGLLSAAGGAGSAEAASRKAGTQASLGREETQRRMAFLLGRLPTESPSELSPQEGEVPRTPSTGGCRLVGAEEATEEAETVRARARQWPESWTASGYLHTPPFSCLSEDKRTANAPPPRPRYLYSGSAVV

SEQ ID NO: 1026049 - protein, 76 aa, Homo sapiens
RLDHARSATYKKAAACHRGAVDAGPRALGLLVTVWGSPFLCQAPIVICISLKSILAGVVAHSYNPNTLGSRGGRIL

SEQ ID NO: 1026050 - protein, 385 aa, Homo sapiens
YKLTISSEEKVFEAVIAWVNHDKDVRQEFMARLMEHVRLPLLPREYLVQRVEEEALVKNSSACKDYLIEAMKYHLLPTEQRILMKSVRTRLRTPMNLPKLMVVVGGQAPKAIRSVECYDFKEERWHQVAELPSRRCGAGMVYMAGLVFAVGGFNGSLRVRTVDSYDPVKDQWTSVANMRDRRSTLGAAVLNGLLYGVGGFDGSTGLSSVEAYNIKSNEWFHVAPMNTRRSSVGVGVVGGLLYAVGGYDGASRQCLSTVECYNATTNEWTYIAEMSTRRSGAGVGVLNNLLYAVGGHDGPLVRKSVEVYDPTTNAWRQVADMNMCRRNAGVCAVNGLLYVVGGDDGSCNLASVEYYNPTTDKWTVVSSCMSTGRSYAGVTVIDKPL

SEQ ID NO: 1026051 - protein, 386 aa, Homo sapiens
PACGAGMTLKINSLYLAMRVFPRPASESPPLGARSDAEDLTAAMSSNECFKCGRSGHWARECPTGGGRGRGMRSRGRGFQFVSSSLPDICYRCGESGHLAKDCDLQEDACYNCGRGGHIAKDCKEPKREREQCCYNCGKPGHLARDCDHADEQKCYSCGEFGHIQKDCTKVKCYRCGETGHVAINCSKTSEVNCYRCGESGPLHGNAQLRLQPNNFPLCRPSFFLIDDRVHFSESSSLPKVGTIEATPGSELYCAVSTAEGVNKNRLCAITTTKVMSAGTRSKDKVGKEPFVACELGMAGMASGESEPVSRLGPWTVPCGGNTRMRRTPNIRDGRGRLRPTAKTPERVGHWKRGGPQKTLQADTARTNTGGTGGHKQPRTGETEVD

SEQ ID NO: 1026052 - protein, 171 aa, Homo sapiens
MTLKINSLYLAMRVFPRPASESPPLWARSDAEDLTAAMSSNECFKCGRSGHWARECPTGGGRGRGMRSRGRGGFTSDRGSSLFPRLFQIFVIAVVSLVILPRIVIFRRMPAITAVEVATLPRTARSPRESESNAATTVANQAIWLVTATMQMSRNAILVENSDTFKKTAPK

SEQ ID NO: 1026053 - protein, 175 aa, Homo sapiens
PACGAGMTLKINSLYLAMRVFPRPASESPPLGARSDAEDLTAAMSSNECFKCGRSGHWARECPTGGGRGRGMRSRGRGFQFVSSSLPDICYRCGESGHLAKDCDLQEDACYNCGRGGHIAKDCKEPKREREQCCYNCGKPGHLARDCDHADEQKCYSCGEFGHIQKDCTKVKCYR

SEQ ID NO: 1026054 - protein, 231 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSRAVYPSTGVAMRSTGPKHSTLAPVRSQERETCVSHTSAQDTTIQSRGGARQCTIAQSRAKVHAVHVANTWYNTEDMEALGYERIDLSVFDVTRAARFESVLPEGCKRFFSRRFAPLGAGSRLLQHFEDNLETIGCAQIPQCQCNP

SEQ ID NO: 1026055 - protein, 269 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1026056 - protein, 269 aa, Homo sapiens; identical to SEQ ID NO: 1026055

SEQ ID NO: 1026057 - protein, 269 aa, Homo sapiens; identical to SEQ ID NO: 1026055

SEQ ID NO: 1026058 - protein, 269 aa, Homo sapiens; identical to SEQ ID NO: 1026055

SEQ ID NO: 1026059 - protein, 30 aa, Homo sapiens
MAAALFVLLGFALPTTHAPTRPNRGVRLEA

SEQ ID NO: 1026060 - protein, 269 aa, Homo sapiens; identical to SEQ ID NO: 1026055

SEQ ID NO: 1026061 - protein, 202 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGAGAGHHHLHLREAPEARGRPG

SEQ ID NO: 1026062 - protein, 72 aa, Homo sapiens
DPGLGQPDNLLPSQGLFYFIYYLIRSSSPTHGTRNQQSGTFKSTGCFPQFQELVSTCYKLVEKLESGSVFHP

SEQ ID NO: 1026063 - protein, 199 aa, Homo sapiens
KNVRMPLRKNPEFATFIETPSFKGREVPVWPQERNVHTLPYSTPEAGTDPKKCGPTLAMSLKAHCTFFSKFPKVYAERNHALPSETTFLTGTLTHMRVFHVFSLITFICPPEICACHPYARKPSTEELARPRPKRFWKGEATCETPPEGKADHEISSPDRSAVPPWCPTQKDRGWGWVQHTEFPFKRRIWSWTWSSPLQ

SEQ ID NO: 1026064 - protein, 63 aa, Homo sapiens
DDKERSPRCVSHPPITHTSGHCFRTAPDPPESLIPVAPLAEFSSPSYLKHVFQSLAPPSLGIW

SEQ ID NO: 1026065 - protein, 424 aa, Homo sapiens
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTVKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 1026066 - protein, 424 aa, Homo sapiens; identical to SEQ ID NO: 1026065

SEQ ID NO: 1026067 - protein, 254 aa, Homo sapiens
GTRCPRRHGAGEAMAPAASRLRAEAGLGALPRRALAQYLLFLRLYPVLTKAATSGIFVSTWELPVPSMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKPGPQDHSHTGRMGCSTPCSMAGYPQMLQEEAWQSLQGPRASLPQKFRVLFANLAALFWYAYLASLGK

SEQ ID NO: 1026068 - protein, 149 aa, Homo sapiens
PSCPAKEFWAQDRHLLPSMSRLLLAILIIFHLAGLLLRVVLSTHVCCLRHRTKSNSQFKNHHDEGLGARNSVLMGSETVHPPSLLLEGKDASAFAAKMRGGFWPALRMNWRVWTPLQFININYVPLKFRVLFANLAALFWYAYLASLGK

SEQ ID NO: 1026069 - protein, 209 aa, Homo sapiens
GTRCPRRHGAGEAMAPAASRLRAEAGLGALPRRALAQYLLFLRLYPVLTKAATSGIFVSTWELPVPSMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKFRVLFANLAALFWYAYLASLGK

SEQ ID NO: 1026070 - protein, 540 aa, Homo sapiens
VYGHGGGGTPAGWLPTFRAHLPGGQAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 1026071 - protein, 540 aa, Homo sapiens; identical to SEQ ID NO: 1026070

SEQ ID NO: 1026072 - protein, 540 aa, Homo sapiens; identical to SEQ ID NO: 1026070

SEQ ID NO: 1026073 - protein, 540 aa, Homo sapiens; identical to SEQ ID NO: 1026070

SEQ ID NO: 1026074 - protein, 540 aa, Homo sapiens; identical to SEQ ID NO: 1026070

SEQ ID NO: 1026075 - protein, 540 aa, Homo sapiens; identical to SEQ ID NO: 1026070

SEQ ID NO: 1026076 - protein, 540 aa, Homo sapiens; identical to SEQ ID NO: 1026070

SEQ ID NO: 1026077 - protein, 145 aa, Homo sapiens
MTNVPLSVLLMSSAENSEQSNPQATAHAHPDRVAGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 1026078 - protein, 92 aa, Homo sapiens
SRSEMLFQSGDAGWYTVSAKNEAGIVSCTARLDVYTQWHQQSQSTKPKKVRPSASRYAALSDQGLDIKAAFQPEANPSHLTLNTALVESEDL

SEQ ID NO: 1026079 - protein, 92 aa, Homo sapiens; identical to SEQ ID NO: 1026078

SEQ ID NO: 1026080 - protein, 92 aa, Homo sapiens; identical to SEQ ID NO: 1026078

SEQ ID NO: 1026081 - protein, 92 aa, Homo sapiens; identical to SEQ ID NO: 1026078

SEQ ID NO: 1026082 - protein, 92 aa, Homo sapiens; identical to SEQ ID NO: 1026078

SEQ ID NO: 1026083 - protein, 92 aa, Homo sapiens; identical to SEQ ID NO: 1026078

SEQ ID NO: 1026084 - protein, 92 aa, Homo sapiens; identical to SEQ ID NO: 1026078

SEQ ID NO: 1026085 - protein, 92 aa, Homo sapiens; identical to SEQ ID NO: 1026078

SEQ ID NO: 1026086 - protein, 92 aa, Homo sapiens; identical to SEQ ID NO: 1026078

SEQ ID NO: 1026087 - protein, 92 aa, Homo sapiens; identical to SEQ ID NO: 1026078

SEQ ID NO: 1026088 - protein, 435 aa, Homo sapiens [sequence omitted]

SEQ ID NO: 1026089 - protein, 223 aa, Homo sapiens
MTALSLQADLPAESFTLLRWWCGMHGDECSMISCSLKLIGIKKVQGGALEDSQLVGWCGIQEDVFSYAWRLNCNPKKVPNPKIALLNVELELKAEKDNAEIRVHTVEDYQAIVDAEWNILYDKLEKIHHSGAKVVLSKIPIGDWATQYFADRDDVLCWAEVAEGGSGRGQMMGCLSGQMQEPVLKCVCTGDCAGDDGQLFEKNRDWTGEEKILMGGRKGKRRR

SEQ ID NO: 1026090 - protein, 156 aa, Homo sapiens
MTALSLQADLPAESFTLLRWWCGMHGDECSMISCSLKLIGIKKVQGGALEDSQLVGWCGIQEDVFSYAWRLNCNPKKVPNPKIALLNVELELKAEKDNAEIRVHTVEDYQAIVDAEWNILYDKLEKIHHSGARHSKGQSWDCGTFWVAFQTQRKRK

SEQ ID NO: 1026091 - protein, 150 aa, Homo sapiens
MTALSLQADLPAESFTLLRWWCGMHGDECSMISCSLKLIGIKKVQGGALEDSQLVGWCGIQEDVFSYAWRLNCNPKKVPNPKIALLNVELELKAEKDNAEIRVHTVEDYQAIVDAEWNILYDKLEKIHHSGAKCCLVQDSHMICGHRSTL

SEQ ID NO: 1026092 - protein, 73 aa, Homo sapiens
GFKIVKVPDAYLGGKQAIFAPDNVGRVFVGISTMRTIDAVDFDGVELQGAGKDGIYIPDDNHKAIFFVNTPAK

SEQ ID NO: 1026093 - protein, 246 aa, Homo sapiens
MYTHHALHHTTSNVKDIPMRRQAALGSRGSELKVSSHHVGEGLCSGRPCLQPHYLPMTDPFPITQGPSLAQMDAYSSVYCQACGCGCMWVFTHMPGMRDCLCVHACTATCLPMCLSGNVYHLCACSCVLLDSNPFSPVLHSNDNSSLTPKPKGKTSSRSNSALTDTSTLRATILHCLQILPTMTDVPEVFGFTTLPNPPLLFSEGPSQGYIPPPQFSLREINLPEINQGRCVSKGHGPPWQGWGFY

SEQ ID NO: 1026094 - protein, 195 aa, Homo sapiens
AIYLPGLLYLSLTISLTMKRHLPGLLYLSLTISLTMKCHLSAWPPLSLTHDLTHDEAPSARPPLSLTHDLTHDEAPSARPPLTLTHDLTHDEVPSICLASSISHSRSHYTMKRHLSARPPLTLTHDLTHDEAPSICPASSTLTHDLTHDEVPSARPPLSLTHDLTHDEVPSICPASSNSHSRSHSRRSAIYLPGL

SEQ ID NO: 1026095 - protein, 241 aa, Homo sapiens
ELQPPGTRDPAPPLITPATPQLSAAPDAMDPALAAQMSEAVAEKMLQYRRDTAGWKICREGNGVSVSWRPSVEFPGNLYRGEGIVYGTLEEVWDCVKPAVGGLRVKWDENVTGFEIIQSITDTLCVSRTSTPSAAMKLISPRDFVDLVLVKRYEDGTISSNATHVEHPLCPPKPGFVRGFNHPCGCFCEPLPGEPTKTNLVTFFHTDLSGYLPQNVVDSFFPRSMTRFYANLQKAVKQFHE

SEQ ID NO: 1026096 - protein, 106 aa, Homo sapiens
MKLISPRDFVDLVLVKRYEDGTISSNATHVEHPLCPPKPGFVRGFNHPCGCFCEPLPGEPTKTNLVTFFHTDLSGYLPQNVVDSFFPRSMTRFYANLQKAVKQFHE

SEQ ID NO: 1026097 - protein, 132 aa, Homo sapiens
GEYGTCFRPWRHGRGCGASPTGWVSILKISRSREDSWVEGTARDETRSLYHGHFHWAGLCLPAWRSSPAPLLQIITQLCCCLHREPTKTNLVTFFHTDLSGYLPQNVVDSFFPRSMTRFYANLQKAVKQFHE

SEQ ID NO: 1026098 - protein, 106 aa, Homo sapiens; identical to SEQ ID NO: 1026096

SEQ ID NO: 1026099 - protein, 106 aa, Homo sapiens; identical to SEQ ID NO: 1026096

SEQ ID NO: 1026100 - protein, 241 aa, Homo sapiens; identical to SEQ ID NO: 1026095

SEQ ID NO: 1026101 - protein, 111 aa, Homo sapiens
SFQTLATLSKMYLFCTRIQFSSSVVTKPSPSLSIRSTIFPSLSLLSSGVSSSKFLESSLPRKASWSYWKLWLSSGGRLPSSESGRTHGSLRTVGLARRTRAPAPAPAAAQG

SEQ ID NO: 1026102 - protein, 178 aa, Homo sapiens
RGAGGTRSGAGTHPLAARVLDRFAQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 1026103 - protein, 190 aa, Homo sapiens
ALSRGAELRVPGGAKHGMCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 1026104 - protein, 77 aa, Homo sapiens
RGAGGTRSGAGTHPLAARVLDRFAQVGTNLTDIVAQRKITIRELGGCMGPIWSSYYGNCRSLLGLCRGYQYGELMAT

SEQ ID NO: 1026105 - protein, 109 aa, Homo sapiens
ALSRGAELRVPGGAKHGMCLLLGATGVGKTLLVKRLQEVSSRDGKGDLGEPPPTRPTVGTNLTDIVAQRKITIRELGGCMGPIWSSYYGNCRSLLGLCRGYQYGELMAT

SEQ ID NO: 1026106 - protein, 169 aa, Homo sapiens
ALSRGAELRVPGGAKHGMCLLLGATGVGKTLLVKRLQEVSSRDGKGDLGEPPPTRPTVGTNLTDIVAQRKITIRELGGCMGPIWSSYYGNCRSLLVGCNPIWASFREVCLHFCDVQSPTLLCVERGLGYLVTILLMEIGLSYCCFLLGTLSGFWCLRSQAPGRSSQRAC

SEQ ID NO: 1026107 - protein, 77 aa, Homo sapiens; identical to SEQ ID NO: 1026104

SEQ ID NO: 1026108 - protein, 305 aa, Homo sapiens
PSGPWAPARAGAGASGMAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCRALQFPPEGWLRLSLNNGSITHLVIRPNGRVALRTLGDTGFMPPDKITRS

SEQ ID NO: 1026109 - protein, 264 aa, Homo sapiens
EYTSACSSQIVNNLEITSCRKTQTWEQRSQGHILYFNIRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCRALQFPPEGWLRLSLNNGSITHLVIRPNGRVALRTLGDTGFMPPDKITRS

SEQ ID NO: 1026110 - protein, 232 aa, Homo sapiens
PSGPWAPARAGAGASGMAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPAVLRRRSPDRGRLPELHPPRRCQAGGGQLRDLHLSRQRHPLHRVQSTAVSS

SEQ ID NO: 1026111 - protein, 305 aa, Homo sapiens; identical to SEQ ID NO: 1026108

SEQ ID NO: 1026112 - protein, 305 aa, Homo sapiens; identical to SEQ ID NO: 1026108

SEQ ID NO: 1026113 - protein, 305 aa, Homo sapiens; identical to SEQ ID NO: 1026108

SEQ ID NO: 1026114 - protein, 255 aa, Homo sapiens
MAFRQALQLAACGLAGGSAAVLFSAVAVGKPRAGGDAEPRPAEPPAWAGGARPGPGVWDPNWDRREPLSLINVRKRNVESGEEELASKLDHYKAKATRHIFLIRHSQYHVDGSLEKDRTLTPLGREQAELTGLRLASLGLKFNKIVHSSMTRAIETTDIISRHLPGVCKVSTDLLREGAPIEPDPPVSHWKPEAVQYYEDGARIEAAFRNYIHRADARQEEDSYEIFICHANVIRYIVCSIPPLLSAGDFVVLGS

SEQ ID NO: 1026115 - protein, 305 aa, Homo sapiens; identical to SEQ ID NO: 1026108

SEQ ID NO: 1026116 - protein, 305 aa, Homo sapiens; identical to SEQ ID NO: 1026108

SEQ ID NO: 1026117 - protein, 305 aa, Homo sapiens; identical to SEQ ID NO: 1026108

SEQ ID NO: 1026118 - protein, 305 aa, Homo sapiens; identical to SEQ ID NO: 1026108

SEQ ID NO: 1026119 - protein, 305 aa, Homo sapiens; identical to SEQ ID NO: 1026108

SEQ ID NO: 1026120 - protein, 255 aa, Homo sapiens; identical to SEQ ID NO: 1026114

SEQ ID NO: 1026121 - protein, 546 aa, Homo sapiens
HVLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIFGNHYSLYMSELMQGSTLINAVNVRNPSVGNYAFLYTRECTQERKPYECSECGKKPFIRNSQLIVHQRTHSGEKPYGCNECGKTFSQKSILSAHQRTHTGEKPCKCTECGNSLLLEVTAHYASENSCR

SEQ ID NO: 1026122 - protein, 527 aa, Homo sapiens
MLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGDIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFILGNHYSLYMSELMQGSTLINAVNVRNPSVGNYAFLYTRECTQERKPYECSECGKKPFIRNSQLIVHQRTHSGEKPYGCNECGKTFSQKSILSAHQRTHTGEKPCKCTECGNSLLLEVTAHYASENSCR

SEQ ID NO: 1026123 - protein, 546 aa, Homo sapiens; identical to SEQ ID NO: 1026121

SEQ ID NO: 1026124 - protein, 179 aa, Homo sapiens
MQVTGPARPFHRLRPPDTHPRGSVHAAGVLDGLASGRPGLLGAPAPAPALTQHPSLPQGAGALPAGRRRPDRPRPAPPWPLSPRPSHLPSRVSAAPPPAGSRGLLETQDTSGFASPGRRPRDRRPARLVRVRVRTPMARLVVTTAAAATAESASAATVMRGMSGDTPSTVALALYSKGE

SEQ ID NO: 1026125 - protein, 82 aa, Homo sapiens
LFLMAAAMAGQEDPVQREIHQDWANREYIEIITSSIKKIADFLNSFDMSCRSRLATLNEKLTALERRIEYIEARVTKGETLT

SEQ ID NO: 1026126 - protein, 240 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAATLTTP

SEQ ID NO: 1026127 - protein, 399 aa, Homo sapiens
MDAALLLGDFPLLPPPGSAREIFDSRGNPTVEVDLFTSKGLFRAAVPSGASTGIYEALELRDNDKTRYMGKGVSKRALHFKLKTLFGALAALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFRSPDDPQQVHLGLTQLADLYQVPSFTRTTQWMSIDRSLDQRVTGELGEKFTSPDAGIQVVGDDLTVTNQKRIDKAVNEKSCNGSCSSQPDSLRNESASGVRVASQGWGARGLIAGRRNTKDRV

SEQ ID NO: 1026128 - protein, 125 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCNLRLPG

SEQ ID NO: 1026129 - protein, 384 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFRSPDDPQQVHLGLTQLADLYQVPSFTRTTQWMSIDRSLDQRVTGELGEKFTSPDAGIQVVGDDLTVTNQKRIDKAWNEKSCNGSCSSQPDSLRNESASGVRVASQGWGARGLIAGRRNTKDRV

SEQ ID NO: 1026130 - protein, 395 aa, Homo sapiens
MDAALLLGDFPLLPPPGSAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFRSPDDPQQVHLGLTQLADLYQVPSFTRTTQWMSIDRSLDQRVTGELGEKFTSPDAGIQVVGDDLTVTNQKRIDKAWNREVLHWLLLKSPDSLRNESASGVRVASQGWGARGLIAGRRNTKDRV

SEQ ID NO: 1026131 - protein, 384 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANRLAERVPCRLRAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFRSPDDPQQVHLGLTQLADLYQVPSFTRTTQWMSIDRSLDQRVTGELGEKFTSPDAGIQVVGDDLTVTNQKRIDKAWNEKSCNGSCSSQPDSLRNESASGVRVASQGWGARGLIAGRRNTKDRV

SEQ ID NO: 1026132 - protein, 436 aa, Homo sapiens
WHEGRSPARARLQPQPDPASTEAERRTPYPGSIGAPAGEGKVPGLVIYLLWPWQNQDEALSCLPSEAYSLSRQHGLPLAVNTMSAGGGRAFAWQVFPPMPTCRVYGTVAHQDGHLLVLGGCGRAGLPLDTAETLDMASHTWLALAPLPTARAGAAAVVLGKQVLVVGGVDEVQSPVAAVEAFLMDEGRWERRATLPQAAMGVATVERDGMVYALGGMGPDTAPQAQVRVYEPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGV

SEQ ID NO: 1026133 - protein, 227 aa, Homo sapiens
MVYALGGMGPDTAPQAQVRVYEPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGV

SEQ ID NO: 1026134 - protein, 443 aa, Homo sapiens
WHEGRSPARARLQPQPDPASTEAERRTPYPGSIGAPAGEGKVPGLVIYLLWPWQNQDEALSCLPSEAYSLSRQHGLPLAVNTMSAGGGRAFAWQVFPPMPTCRVYGTVAHQDGHLLVLGGCGRAGLPLDTAETLDMASHTWLALAPLPTARAGAAAVVLGKQVLVVGGVDEVQSPVAAVEAFLMDEGRWERRATLPQAAMGVATVERDGMVYALGGMGPDTAPQAQVRVYEPRRDCWLSLPSMPTPCYGASTFLHGNKIYVLGTPIPLTGGRQGKLPVTAFEAFDLEARTWTRHPSLPSRRAFAGCAMAEGSVFSLGGLQQPGPHNFYSRPHFVNTVEMFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGV

SEQ ID NO: 1026135 - protein, 402 aa, Homo sapiens
WHEGRSPARARLQPQPDPASTEAERRTPYPGSIGAPAGEGKVPGLVIYLLWPWQNQDEALSCLPSEAYSLSRQHGLPLAVNTMSAGGGRAFAWQVFPPMPTCRVYGTVAHQDGHLLVLGGCGRAGLPLDTAETLDMASHTWLALAPLPTARAGAAAVVLGKQVLVVGGVDEVQSPVAAVEAFLMDEGRWERRATLPQAAMGVATVERDGMVYALGGMGPDTAPQAQVRVYEPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGNQPCPLGSVESFSLARRRWEALPAMPTARCSCSSLQAGPRLFVIGGVAQGPSQAVEALCLRDGV

SEQ ID NO: 1026136 - protein, 359 aa, Homo sapiens
WHEGRSPARARLQPQPDPASTEAERRTPYPGSIGAPAGEGKVPGLVIYLLWPWQNQDEALSCLPSEAYSLSRQHGLPLAVNTMSAGGGRAFAWQVFPPMPTCRVYGTVAHQDGHLLVLGGCGRAGLPLDTAETLDMASHTWLALAPLPTARAGAAAVVLGKQVLVVGGVDEVQSPVAAVEAFLMDEGRWERRATLPQAAMGVATVERDGMVYALGGMGPDTAPQAQVRVYEPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGEQWLFWAVLPLSVGWRGIVCT

SEQ ID NO: 1026137 - protein, 359 aa, Homo sapiens; identical to SEQ ID NO: 1026136

SEQ ID NO: 1026138 - protein, 266 aa, Homo sapiens
GTRAGAPPEPDFSPSQIPRQRRRNGGPRTLAASEHRRDGMVYALGGMGPDTAPQAQVRVYEPRRDCWLSLPSMPTPCYGASTFLHGNKIYVLGGRQGKLPVTAFEAFDLEARTWTRHPSLPSRRAFAGCAMAEGSVFSLGGLQQPGPHNFYSRPHFVNTVEMFDLEHGSWTKLPRSLRMRDKRADFVVGSLGGHIVAIGGLGNQPCPLGSVESFSLARRRWEALPAMPTARCSCSSLQAGPRLFVIGGVAQGPSQAVEALCLRDGV

SEQ ID NO: 1026139 - protein, 436 aa, Homo sapiens; identical to SEQ ID NO: 1026132

SEQ ID NO: 1026140 - protein, 182 aa, Homo sapiens
MKSFLLVVNALALTLPFLAVEVQNQKQPACHENDERPFYQKTAPYVPMYYVPNSYPYYGTNLYQRRPAIAINNPCVPRTYYANPAVVRPHAQIPQRQYLPNSHPPTVVRRPNLHPSFIAIPPKKIQDKIIIPTINTIATVEPTPAPATEPTVDSVVTPEAFSESIITSTPETTTVAVTPPTA

SEQ ID NO: 1026141 - protein, 182 aa, Homo sapiens
MKSFLLVVNALALTLPFLAVEVQNQKQPACHENDERPFYQKTAPYVPMYYVPNSYPYYGTNLYQRRPAIAINNPYVPRTYYANPAVVRPHAQIPQRQYLPNSHPPTVVRRPNLHPSFIAIPPKKIQDKIIIPTINTIATVEPTPTPATEPTVDSVVTPEAFSESIITSTPETTTVAVTPPTA

SEQ ID NO: 1026142 - protein, 44 aa, Homo sapiens
MSQQLGAQPRPNLVERRNIRCSRRNLIIYERGQLTGLHFSKPIL

SEQ ID NO: 1026143 - protein, 93 aa, Homo sapiens
RPAYPYCVSSGLRDCKRASLKRSGLWAAEPPGILTAEQEAEVRVQDGLKMSQQLGAQPRPNLVERRNIRCSRRNLIIYERGQLTGLHFSKPIL

SEQ ID NO: 1026144 - protein, 1230 aa, Homo sapiens
MDPAAPWLFWEAAAPALKRPWLLMVAPRLPAGARDSGQFPRKGQAGSPSRGRVRKLGGAEATLGPRTPCLVTVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGCHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQVGRRHPGSARGWGSRSRRKGWERP

SEQ ID NO: 1026145 - protein, 95 aa, Homo sapiens
RDGGQVGVAGEAALVSQNPVFTCCPACQDLKLVPGVRVKRLETWAAPAPQGWRHRSPCQAAARMVTEKVGTTSWWLLAADSGASAPRGVLEKPVG

SEQ ID NO: 1026146 - protein, 1335 aa, Homo sapiens
MDPAAPWLFWEAAAPALKRPWLLMVAPRLPAGARDSGQFPRKGQAGSPSRGRVRKLGGAEATLGPRTPCLVTVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGCHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 1026147 - protein, 105 aa, Homo sapiens
VFSAGGSAFATQVKPAAEIIPPAIMLPIISAIFFISLNLGYWLTLISCNKERLPCVDKIKRHFVAGFNFTHFRLRGDGKAHGHLRPVHGSNRIVMDGDLFCFPDR

SEQ ID NO: 1026148 - protein, 141 aa, Homo sapiens
MGPKGRTVIIEQSWGSPKVTKDGVTVAKSIDLKDKYKNIGAKLVQDVANNTNEEAGDGTTTATVLARSIAKEGFEKISKGANPVENRRGVMLAVDAVIFELNSSLNCDHPLKKLHRLLRISAKEKKNIGISSLIDEKVGER

SEQ ID NO: 1026149 - protein, 104 aa, Homo sapiens
MGQEFGSQPPHVLMPRVFRQVELKSQEAPSLQQQPDQYAGAPVPQGAWMCGQAGWTPQEHPGLSGEAVGTGEAAGGAGEAACHSFRAAENRELNIPSSKSGSRN

SEQ ID NO: 1026150 - protein, 163 aa, Homo sapiens
TGYSPGSGNHQKWLESVGRQLQAEVENNQMLSLLNRRQEERLHEQEERLHEQEERLREQEERLCEQEERLREHEERLCEQEERLREQEERLCEQEERLREQEERLCEQEERLREQEERLCEQEKLPGQERLLEEVEKLLVQERRQEEQERLHAILFGLRRTGS

SEQ ID NO: 1026151 - protein, 155 aa, Homo sapiens
STTTTKFAAGSTERLCEQEERLHEQEERLHEQEERLREQEERLCEQEERLREHEERLCEQEERLREQEERLCEQEERLREQEERLCEQEERLREQEERLCEQEKLPGQERLLEEVEKLLVQERRQEEQERLLERERLLEEVEKLLEQERSQARAR

SEQ ID NO: 1026152 - protein, 218 aa, Homo sapiens
STTTTKFAAGSTERLCDLLNRRQEERLREQEERLREQEERQREQEDRLHEQEERLREQEERLCEQEERLCEQEERLREHEERLCEQEERLCEQEERLHEQEERLHEQEERLREQEERLCEQEERLREHEERLCEQEERLREQEERLCEQEERLREQEERLCEQEERLREQEERLCEQEKLPGQERLLEEVEKLLVQERRQEEQERLHAILFGLRRTGS

SEQ ID NO: 1026153 - protein, 273 aa, Homo sapiens
AQMVWGAPAVTEHPTPSAWLMLSSFKEALSAALWRRGVRLQGPEWFQSLKPEAGQGSGELARGEWCKAGVRKPHAFSRLQKLLLAWGSEGLGQTASWPPVVSPIPGFLDWVPKKMQRVGCVELLNTVQRRVQPRLHVFGHIHEGYGVMADGTTTYVNASVCTVNYQPVNPPIVIDLPTPRKLLTAPHCPCPARPCQLHRPGPATGSFHAELPGRPIWLRGTGLAGRSGPWNDSLGLLSPGVGTLRIPIRGYLCSFNFIPGVLTSCVYLVQRTY

SEQ ID NO: 1026154 - protein, 184 aa, Homo sapiens
RIREGVDILITHGPPLGFLDWVPKKMQRVGCVELLNTVQRRVQPRLHVFGHIHEGYGVMADGTTTYVNASVCTVNYQPVNPPIVIDLPTPRKLLTAPHCPCPARPCQLHRPGPATGSFHAELPGRPIWLRGTGLAGRSGPWNDSLGLLSPGVGTLRIPIRGYLCSFNFIPGVLTSCVYLVQRTY

SEQ ID NO: 1026155 - protein, 68 aa, Homo sapiens
RQSEGETLASPSSHPALSPMGHTQLQPVAWGGPCHAGVCKAGPGPGKDGGSSTQVAMLSGYWADTAHN

SEQ ID NO: 1026156 - protein, 106 aa, Homo sapiens
MFQPLSSKVLPQGPGMVAHTCNPNPLGGQSKQITRSGNWDHPGQHGEIPSVLKVQKLAECGSVCLWSQLLGRLRQEDCLSPGGGGCSESRLAIAAQPGYRSESVSQ

SEQ ID NO: 1026157 - protein, 71 aa, Homo sapiens
GGADKRIQVPKAREGYEENEEFLRTCTTAAGGGSDRGHLAGGRMFPSAGDPQLLLSEEETESGLCQAPVLL

SEQ ID NO: 1026158 - protein, 167 aa, Homo sapiens
MGKYYSCESMADNACVLFAVSVLRFIISSVLVYGAISYQVGWLIPFFCYRLFDFVLSRLVAISSLTYLPRIKEYLDQLPDFPYKDDLLALDSSCLLFIVLVFLALFIIFKAYLINCVGNCYKYINNRNVPEMAVYPAFEAPPQYVLPTYEMAVKMPEKEPPPPYLPA

SEQ ID NO: 1026159 - protein, 221 aa, Homo sapiens
TESHSVVQAGVHDVILAHWKLPPPRFKQFSCLSPLSSWDYSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNAREIQAL

SEQ ID NO: 1026160 - protein, 141 aa, Homo sapiens
PSFRSFNSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPRNVLLKLLKL

SEQ ID NO: 1026161 - protein, 1287 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026162 - protein, 1195 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGSGAAGLWVAEIGYRRS

SEQ ID NO: 1026163 - protein, 1288 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSYNLPQQPGLNSNNTLPCQLHNLRPQGGINSIPQQPDAMGSGTTPSSAHSTTSGRGESTTSRISPGSTEITALPGSTTTPGLSEKSTTFYSSPRSPDTTHLPARMTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEESTTFYSSPPAAEMRDP

SEQ ID NO: 1026164 - protein, 1287 aa, Homo sapiens; identical to SEQ ID NO: 1026161

SEQ ID NO: 1026165 - protein, 1287 aa, Homo sapiens; identical to SEQ ID NO: 1026161

SEQ ID NO: 1026166 - protein, 950 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLLPDNTTASASLNNLRPSTAARAKLGR

SEQ ID NO: 1026167 - protein, 1206 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSYNLPQQPGLNSNNTLPCQLHNLRPQGGINSIPQQPDAMGSGTTPSSAHSTTSGRGESTTSRISPGSTEITTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026168 - protein, 1011 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTGTYNFPQQPRLNRGNTVPWQYHSLIPWSTIYNLPQQPRRHRETGFPRRDDRSSERPGGMLERLQVDIGSIHKTLTPFQFHMAYAISRKYVVLCRCARGFTVTNLYLHGTKSSPVCEACYNCTRSSELE

SEQ ID NO: 1026169 - protein, 821 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRQSKLNRNNNFTRQSHNTKPQ

SEQ ID NO: 1026170 - protein, 928 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSYNLPQQPGLNSNNTLPCQLHNLRPQGGINSIPQQPDAMGTTVLPAGSTPSVLVGDSTPSPISSGSMETTALPGSTTTPGLSEKSTTFYSSPRSPETLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEESTTFYSSPPAAEMRDP

SEQ ID NO: 1026171 - protein, 739 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSLDSRENFLHHRPSQPQSHHVITTQAHILQLL

SEQ ID NO: 1026172 - protein, 770 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGPTDTTLSPVRNQQLSISSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026173 - protein, 470 aa, Homo sapiens
GSDQCIVITCIVITCIVITCIVIQCIVTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026174 - protein, 454 aa, Homo sapiens
RCSRGCYHVHVTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026175 - protein, 599 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026176 - protein, 377 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTSPAPSGTTSAFVKLSTTYHSSPSSTPKPTPPYYQTTLK

SEQ ID NO: 1026177 - protein, 208 aa, Homo sapiens
GALEDAITCMTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHHFSASSTTLGRSEESTTVHSSPGATGTALFPTRSATSVLVGEPTTSPISSGSTETTALPGSTTTAGLSEKSTTFYSSPPAAEMRDP

SEQ ID NO: 1026178 - protein, 281 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSYNLPQQPGLNSNNTLPCQLHNLRPQGGINSIPQQPDAMGSGTTPSSAHSTTSGRGESTTSRISPGSTEITAARSTTSGLVEESTTYHSSPGSTQTMHFPESDTTSGRGEESTTSHSSTTHTISSAPSTTSALVEEPTSYHSSPLQQHTSLTAPQPQAVVRNQSASTQQAMIDYRRQ

SEQ ID NO: 1026179 - protein, 204 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026180 - protein, 114 aa, Homo sapiens
VEPWLLWEDTTLTPASSTSAGLQEESTTFQSWPSSSDTTPSPPGTTAAPVEVSTTYHSRPSSTPTTHFSASSTTLGRSEKSTTVHSSPGATGTALFPTRSATSVLVGEPTTSPG

SEQ ID NO: 1026181 - protein, 1205 aa, Homo sapiens
MEVIQLLHPHPVQATFYTFSDYGVSVTFITGSTATKHFLDSSTNSGHSEESTVSHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026182 - protein, 1148 aa, Homo sapiens
MAATVLPAGSTPSVLVGDSTPSPISSGSMETTALPGSTTTPGLSEKSTTFYSSPRSPDTTHLPARMTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDPESH

SEQ ID NO: 1026183 - protein, 865 aa, Homo sapiens
MHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPPAAEMRDP

SEQ ID NO: 1026184 - protein, 685 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTSWTSGRIYRLPDPPSLNSHDAFTS

SEQ ID NO: 1026185 - protein, 1265 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026186 - protein, 1288 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSAGLQEESTTFQSWPSSSDTTPSPPGTTAAPVEVSTTYHSRPSSTPTTHFSASSTTLGRSEKSTTVHSSPGATGTALFPTRSATSVLVGEPTTSPISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEESTTFYSSPPAAEMRDP

SEQ ID NO: 1026187 - protein, 1178 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026188 - protein, 1113 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026189 - protein, 444 aa, Homo sapiens
MTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPPAAEMRDP

SEQ ID NO: 1026190 - protein, 1090 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSLDFRENLPPSRPTQPQLTRRLHLLAPQQPLLKNLQPTTAAQARLQQHTSLPAPQLRATVRNQQYSTAAQMQVEQHPHLPTPQPQVVENLQPHVSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026191 - protein, 846 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEEINNSPQQPRCNWNSTLPYPLCNLSSCWRTYNVTHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026192 - protein, 702 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGILSCTPESTNGRKQTQPAPM

SEQ ID NO: 1026193 - protein, 598 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSPTRFYSLNSVTCQHHHARPQ

SEQ ID NO: 1026194 - protein, 550 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTRNVLLKLLKL

SEQ ID NO: 1026195 - protein, 529 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTYKWNHTLTCPFYYLRPHCYYHPRYMQ

SEQ ID NO: 1026196 - protein, 652 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSYNLPQQPGLNSNNTLPCQLHNLRPEGGIKSIPQQARCNGKWNNTLSAHSTTSGRGESTTSRISPGSTEITRYPAVPQHQASVRNLPLSTVAPDHQNHNTLTCCMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPPAAEMRDP

SEQ ID NO: 1026197 - protein, 454 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026198 - protein, 454 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSYNLPQQPGLNSNNTLPCQLHNLRPQGGINSIPQQPDAMGTTVLPAGSTPSVLVGDSTPSPISSGSMETTALPGSTTTPGLSEKSTTFYSSPRSPETLSPASTTSSGVSEESTTSHSRPGSTHTTAFPDSTTTPGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026199 - protein, 390 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSYNLPQQPGLNSNNTLPCQLHNLRPEGGIKSIPQQARCKGTTVLPAGSTPSVLVGDSTPSPISSGSMETTALPGSTTTPGLSEKSTTFYSSPRSPETLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSLTPGRTFSITDHPNLNHTTSSLPRPISYNFYNSGTSSIRSC

SEQ ID NO: 1026200 - protein, 235 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRGSAVIYNLTHQSRLKGNNNVTLAVPQTPGLSEASTTFYSSPRSPTTTLSPASMTSLGVGEESTTSRSQPGSTHSTVSPASTTTPGLSEESTTVHKPAAQESTRPRI

SEQ ID NO: 1026201 - protein, 990 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSMAQPTSSTSRGKSGAELD

SEQ ID NO: 1026202 - protein, 930 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRALSCSQHLTLAARA

SEQ ID NO: 1026203 - protein, 839 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSRLQQQPRLN

SEQ ID NO: 1026204 - protein, 857 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSQGTDVCVFEPGCCGKLLIPDWKPDAGV

SEQ ID NO: 1026205 - protein, 741 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPRNVLLKLLKL

SEQ ID NO: 1026206 - protein, 641 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGST

SEQ ID NO: 1026207 - protein, 470 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSP

SEQ ID NO: 1026208 - protein, 629 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRGSAVIYNLTHQSRLKRNNNVTWQYHKHQASVRHLPPSTAAPDHHPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTPGLSEESTTFYSSPPAAEMRDP

SEQ ID NO: 1026209 - protein, 276 aa, Homo sapiens
ESVPQSLSVPMEYTASSLGSQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRGSAVIYNLTHQSRLKGNNNVTWQYHKHQASVRHLPPSTAAPDHHPRSPTTTLSPASMTSLGVGEESTTSRSQPGSTHSTVSPASTTTPGLSEESTTGILQLPTAAQAQRIQHCTCLVSAYGTGLEGGTTGIQSEFFITTTRDPGLNG

SEQ ID NO: 1026210 - protein, 186 aa, Homo sapiens
MAVFLLLLSSVNGLSGPQFLWFLSSPGCVPPPPFFCKWPVRASGLERSLGNLPHQQEAAGQLDLGNVDSQIYLQPRPLWTCSALVPTAEATSCPSGCQWHLCPSICLLSFRYPSFSHMAPLVHQQSLWLYFHSTSHHFPPLPDYLAASGHQCLSQESPKWSPPSPPPNISREHSSRVIAFSNRLQP

SEQ ID NO: 1026211 - protein, 241 aa, Homo sapiens
SRLSRGRQAPRRAEGLHVRDAPTSGCALLERGPHPDTAIEEIKEKSEDCKTQNLGIVWEKADAWRKAHSAPTLPSGLAEDEILHRVALRRQSSICGPSIPKIDSEIRQGEHGSTKSALRLVSKCTWIVQPWWVTVELGFLLSSSCMTAVIWRGPKKNGMIKQFLRDVDWGEVDYLIVDTPPGTSDEHLSVVRYLATAHIDGAVIITIPRRCHSGGPGESILAQGNLPSRGGGTLRAPFLGN

SEQ ID NO: 1026212 - protein, 194 aa, Homo sapiens [sequence omitted]

SEQ ID NO: 1026213 - protein, 45 aa, Homo sapiens
MRTFPKDAFMINTKLVLVCSAATVLVIRSSYPLIDHTLLSEAVTL

SEQ ID NO: 1026214 - protein, 274 aa, Homo sapiens
MFSSSAKIVKPNGEKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYPTLMGSDDNFYSPHLQLATEMNNGEDFFINHSSHTFVFKAKILLHTLREPLSIPVDHYLALVITFAPPHPPPPLNTTPCVPSNAIIYYQLDRSPRPK

SEQ ID NO: 1026215 - protein, 104 aa, Homo sapiens
MIIFTLQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 1026216 - protein, 63 aa, Homo sapiens
MFSSSAKIVKPNGEKPDEFESGISQALLELEMNSDLKAQLRELNITAAKEIEVGGDLLKVIFC

SEQ ID NO: 1026217 - protein, 194 aa, Homo sapiens [sequence omitted]

SEQ ID NO: 1026218 - protein, 164 aa, Homo sapiens
LGDQGAPRGAADYGSPAAGIPPRRGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 1026219 - protein, 187 aa, Homo sapiens
MFSSSAKIVKPNGEKPDEFESGISQALLELEMNSDLKAQLRELNITAAKEIEVGGGRKAIIIFVPVPQLKSFQKIQVRLVRELEKKFSGKHVVFIAQRRSLPKSSDEHDVMLEDLDIQAKVPAGDTASDYDGTRIIQVHYDRAQQNTVAHTVATLSECYETLTVNDAKFEFADFQLLTCTTHWVYSQ

SEQ ID NO: 1026220 - protein, 104 aa, Homo sapiens; identical to SEQ ID NO: 1026215

SEQ ID NO: 1026221 - protein, 492 aa, Homo sapiens [sequence omitted]

SEQ ID NO: 1026222 - protein, 492 aa, Homo sapiens [sequence omitted]

SEQ ID NO: 1026223 - protein, 492 aa, Homo sapiens [sequence omitted]

SEQ ID NO: 1026224 - protein, 396 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQPRREQQPALRGGPRLSL

SEQ ID NO: 1026225 - protein, 476 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGALPPAPDGTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026226 - protein, 349 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAHWLRHRPRRQGLGLPGLHRDQPDLRQQQCDRYVPRPALH

SEQ ID NO: 1026227 - protein, 376 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQISEPPATSSSPTGTWTPGQGAGFGGT

SEQ ID NO: 1026228 - protein, 515 aa, Homo sapiens
MGSAPWAPVLLLALGLRGLQAGGEWRRPPAHSPVPAPPLRFASPHARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026229 - protein, 354 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVRRRLSKGATGEGRPGVSTKAGGQRPDPHPGAREAELVEEGPTLMSPLLLHPLRPDSYCSALAR

SEQ ID NO: 1026230 - protein, 325 aa, Homo sapiens
CGDLEDPGLPLGCGGAGVQRAVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026231 - protein, 470 aa, Homo sapiens
MGSAPWAPVLLLALGLRGLQAGGEWRRPPAHSPVPAPPLRFASPHSPQGPGPRLPGALLPAASGPLQLRALRQQDLPSALPGVGQVLGPGRGAHLLLHWERGRRVGLRQQLGLRRGAGGRAGGSTGLRGAPLLREVAAVRCAVHAARAHGAADGGAGPGRLRRAAPRATTRPRGPGCPRHRLRWKDFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026232 - protein, 280 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGATTRRRGSRHCSVSERRPDQSSCSPHAYVLHEGFPTMILVLRNRRA

SEQ ID NO: 1026233 - protein, 436 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRSQSRQQHHLLQREPGPLGRGRDSEEPECLSHRRHHPGGSAPPRPQSLPPRRSCFRG

SEQ ID NO: 1026234 - protein, 662 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGALPPAPDGQVWRPRLGLGPGAGWGEDPQPGQGLCLLPQGCGGVDSTTFPETLGEAGAVPGDPLSTGCSQAQLGGCCPRGPWGPQHGGQQRAAGPTLPRGERGASTVRPGAGSTDTADLQAGSLEGLPHWDLQIQSPDPLEEPFRGGTGWWPEPAVCLCVAAGPQRLSSPGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026235 - protein, 376 aa, Homo sapiens; identical to SEQ ID NO: 1026227

SEQ ID NO: 1026236 - protein, 345 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPPGQGAGFGGT

SEQ ID NO: 1026237 - protein, 565 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGKEALPPVLPATCSAWMCGHTSGLSQWELHPHLAQGWNLWVSEVSSSLWHLWAPEEEKRKWGVGGSSLTLCPSPSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026238 - protein, 406 aa, Homo sapiens
MSLPSALPGVGQVLGPGRGAHLLLHWERGRRVGLRQQLGLRRGAGGRAGGSTGLRGAPLLREVAAVRCAVHAARAHGAADGGAGPGRLRRAAPRATTRPRGPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026239 - protein, 357 aa, Homo sapiens
MGSAPWAPVLLLALGLRGLQAGGEWRRPPAHSPVPAPPLRFASPHARRAPDPGFQERFFQQRLDQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026240 - protein, 295 aa, Homo sapiens
LDVSTVSFPQDFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026241 - protein, 377 aa, Homo sapiens
VQFPNVTGARGRRHGLRSLGPGPAAGARAARPPGGGPQGPGPRLPGALLPAASGPLQLRALRQQDLPSALPGVGQVLGPGRGAHLLLHWERGRRVGLRQQLGLRRGAGGRAGGSTGLRGAPLLREVAAVRCAVHAARAHGAADGGAGPGRLRRAAPRATTRPRGPGCPRHRLRWKAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRSQSRQQHHLLQREPGPLGRGRDSEEPECLSHRRHHPGGSAPPRPQSLPPRRSCFRG

SEQ ID NO: 1026242 - protein, 241 aa, Homo sapiens
MGSAPWAPVLLLALGLRGLQAGARRAPDPGFQERFFQQRLDHFNFERFGNKTFPQRFLVSEWRPPALARARPSQDANRAHSVNPTPVMQKLNNEKRINGYTAEKRTNNICDNRRSNVEAKVVEHHSTERNQNFDQQVTEEATEKTTRHISQDDHAPPTAKLDRPHGTPPKTTPGTKSDACMHGKEQRPGNDDTETHDTHADHEKRPHTPQGKRPAQTNPALKHKGRDRPGQQTQQTDSKYT

SEQ ID NO: 1026243 - protein, 492 aa, Homo sapiens [sequence omitted]

SEQ ID NO: 1026244 - protein, 492 aa, Homo sapiens [sequence omitted]

SEQ ID NO: 1026245 - protein, 460 aa, Homo sapiens
VQFPNVTGARGRRHGLRSLGPGPAAGARAARPPGGGPQGPGPRLPGALLPAASGPLQLRALRQQDLPSALPGVGQVLGPGRGAHLLLHWERGRRVGLRQQLGLRRGAGGRAGGSTGLRGAPLLREVAAVRCAVHAARAHGAADGGAGPGRLRRAAPRATTRPRGPGCPRHRLRWKDFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026246 - protein, 465 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTAAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 1026247 - protein, 391 aa, Homo sapiens
VQFPNVTGARGRRHGLRSLGPGPAAGARAARPPGGGPQGPGPRLPGALLPAASGPLQLRALRQQDLPSALPGVGQVLGPGRGAHLLLHWERGRRVGLRQQLGLRRGAGGRAGGSTGLRGAPLLREVAAVRCAVHAARAHGAADGGAGPGRLRRAAPRATTRPRGPGCPRHRLRWKAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRSQSRQQHHLLQREPGPLGRGRDSEEPECLSHRRHHPGGSAPPRPQSSTKKSVRDEAKLRPYRMGKSTLPQ

SEQ ID NO: 1026248 - protein, 68 aa, Homo sapiens
TTLICHDPDTLMVLILQQLRRVQYKPFSNCRRLVCACWITPNCLYLIATPDTLPAKELSDTSGVRDRL

SEQ ID NO: 1026249 - protein, 155 aa, Homo sapiens [sequence omitted]

SEQ ID NO: 1026250 - protein, 256 aa, Homo sapiens
MDDKTKPGHAVDFSVSIPVRAKKEVSPPLSASGNSVVTHSLAFLFLPEECPAGSHRSEHTGACNPCTEGVDYTNASNNEPSCFPCTVCKSDQKHKSSCTMTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMTTSPGTPASSHYLSCTIVGIIVLIVLLIVFV

SEQ ID NO: 1026251 - protein, 386 aa, Homo sapiens
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVESPEEPQRLLEQAEAEGCQRRRLLVPVNDADSADISTLLDASATLEEGHAKETIQDQLVGSEKLFYEEDEAGSATSCL

SEQ ID NO: 1026252 - protein, 299 aa, Homo sapiens [sequence omitted]

SEQ ID NO: 1026253 - protein, 736 aa, Homo sapiens
GSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQEADRAEVSRFAKNFLPILFNLYGQPVAAGDTPAPRRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPPTEASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGPSTVEQLLENVCLLLASRTRDVVKSALGFIKVAVTVMDVAHLAKHVQLVMEAIGELSDDMRRHFRMKLRNLFTKFIRKFGFELVKRLLPEEYHRVLVNIRKAEARAKRHRALSQAAVEEICAVLAAVTEVPRWDTKTAERIVDPEAQGPWAALWSSLRPFQPPGCLATSSRCSRFWQSLDSG

SEQ ID NO: 1026254 - protein, 149 aa, Homo sapiens
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVLRLYVT

SEQ ID NO: 1026255 - protein, 1650 aa, Homo sapiens
MFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWHDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKSKEHKLLRDPQIQARYCSAELQ

SEQ ID NO: 1026256 - protein, 1348 aa, Homo sapiens
LNYKVEGEKLKHKYTIDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKPEYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAK

SEQ ID NO: 1026257 - protein, 2548 aa, Homo sapiens
MFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWHDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKPEYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAK

SEQ ID NO: 1026258 - protein, 629 aa, Homo sapiens
MGRGCSLAVRGSARVAGPAAVADREDLKPAAGQRVNMKYILVTGGVHIRNRKRGIIAIQCGHEYSSHVVYSVTSIKMDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPYLGVCLGMQLAVVEFSRNVLGWQDANSTEFDPTNSHPVARRHARTHPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 1026259 - protein, 629 aa, Homo sapiens; identical to SEQ ID NO: 1026258

SEQ ID NO: 1026260 - protein, 417 aa, Homo sapiens
MPFIEAFRQFQFKVKRENFCNIHVSLVPQPSSTGEQKTKPTQNSVRELRGLGLSPDLVVCRCSNPLDTSVKEVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPYLGVCLGMQLAVVEYSRNVLGWQDANSTEFDPTNSHPVARRHARTHPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 1026261 - protein, 112 aa, Homo sapiens [sequence omitted]

SEQ ID NO: 1026262 - protein, 629 aa, Homo sapiens; identical to SEQ ID NO: 1026258

SEQ ID NO: 1026263 - protein, 602 aa, Homo sapiens
MGRGCSLAVRGSARVAGPAAVADREDLKPAAGQRVNMKYILVTGGVHIRNRKRGIIAIQCGHEYSSHVVYSVTSIKMDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPYLGVCLGMQLAVVEFSRNVLGWQDANSTEFDPTNSHPVARRHARTHPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPR

SEQ ID NO: 1026264 - protein, 493 aa, Homo sapiens
MPASVGTNTRMSCGYSVISIKMDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPRGEPWFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 1026265 - protein, 435 aa, Homo sapiens
MPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPYLGVCLGMQLAVVEYSRNVLGWQDANSTEFDPTNSHPVARRHARTHPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 1026266 - protein, 417 aa, Homo sapiens
MPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRTCSIALVGKYTKFSDSYASVIKALEHSALAINHKLEIKYIDSADLEPITSQEEPVRYHEAWQKLCSAHGVLVPGGFGVRGTEGKIQAIAWARNQKKPYLGVCLGMQLAVVEYSRNVLGWQDANSTEFDPTNSHPVARRHARTHPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 1026267 - protein, 134 aa, Homo sapiens
MPASVGTNTRMSCGYSVISIKMDPYINIDAGTFSPYEHGEVFVLDDGGEVDLDLGNYERFLDIRLTKDNNLTTGKIYQYVINKERKGDYLGKTVQVVPHITDALSPRDTYSDRSGSSSPDSEITELKFPSINHD

SEQ ID NO: 1026268 - protein, 364 aa, Homo sapiens
MALALLEDWCRIMSVDEQKSLMVTGIPADFEEAEIQEVLQETLKSLGRYRLLGKIFRKQENANAVLLELLEDTDVSAIPSEVQGKGGVWKVIFKTPNQDTEFLERLNLFLEKEGQTVSGMFRALGQEGVSPATVPCISPELLAHLLGQAMAHAPQPLLPMRYRKLRVFSGSAVPAPEEESFEVWLEQATEIVKEWPVTEAEKKRWLAESLRGPALDLMHIVQADNPSISVEECLEAFKQVFGSLESRRTAQVRYLKTYQEEGEKVSAYVLRLETLLRRAVEKRAIPRRIADQVRLEQVMAGATLNQMLWCRLRELKDQGPPPSFLELMKVIREEEEEEASFENESIEEPEERDGYGRWNHEGDD

SEQ ID NO: 1026269 - protein, 364 aa, Homo sapiens; identical to SEQ ID NO: 1026268

SEQ ID NO: 1026270 - protein, 364 aa, Homo sapiens; identical to SEQ ID NO: 1026268

SEQ ID NO: 1026271 - protein, 377 aa, Homo sapiens
GGPKRWWDLDLSWCPGSGYCHGKEFKDESENSENMVTGIPADFEEAEIQEVLQETLKSLGRYRLLGKIFRKQENANAVLLELLEDTDVSAIPSEVQGKGGVWKVIFKTPNQDTEFLERLNLFLEKEGQTVSGMFRALGQEGVSPATVPCISPELLAHLLGQAMAHAPQPLLPMRYRKLRVFSGSAVPAPEEESFEVWLEQATEIVKEWPVTEAEKKRWLAESLRGPALDLMHIVQADNPSISVEECLEAFKQVFGSLESRRTAQVRYLKTYQEEGEKVSAYVLRLETLLRRAVEKRAIPRRIADQVRLEQVMAGATLNQMLWCRLRELKDQGPPPSFLELMKVIREEEEEEASFENESIEEPEERDGYGRWNHEGDD

SEQ ID NO: 1026272 - protein, 680 aa, Homo sapiens
MADGGRIRIGALTRRYSGALGGRGCGVDGWTSGIMERGGRRGEEKIREGGEGGEGKGEGGGGGGIRGGTSVKVSGQGATKKRARGAGGGGISHITLYSPPGKPREHARASEHLPSHGHGGGGRGGVERAPLRRQEGLRGARGETAAPSSSCLGDHLLTTQLTTLPPQEKIQTVFEQLVLVDHPNIVKLHKYWLDTSEACARVSTGKAPGRQRPQLGGAGMGTNPQLVEILSSHRAGHLHHRVRVIRQPQAIPQKDQEEPQGHERPGMGSGLGQPRGQDGVGAASGTGMVRGCPAASDRGWARMRGGLRRPSRLSWPTRPTESCVRRQAWKRWCTQILSALSFLHACSPPIIHGNLTSDTIFIQHNGLIKIGSVWHRIFSNALPDDLRSPIRAEREELRNLHFFPPEYGEVADGTAVDIFSFGMCALEMAVLEIQTNGDTRVTEEAIARARHSLSDPNMREFILCCLARDPARRPSAHSLLFHRVLFEVHSLKLLAAHCFIQHQYLMPENVVEEKTKAMDLHAVLAELPRPRRPPLQWRYSEVSFMELDKFLEDVRNGIYPLMNFAATRPLGLPRVLAPPPEEVQKAKTPTPEPFDSETRKVIQMQCNLERSEDKARWHLTLLLVLEDRLHRQLTYDLLPTDSAQDLASELVHYGFLHEDDRMKLAAFLESTFLKYRGTQA

SEQ ID NO: 1026273 - protein, 680 aa, Homo sapiens; identical to SEQ ID NO: 1026272

SEQ ID NO: 1026274 - protein, 680 aa, Homo sapiens; identical to SEQ ID NO: 1026272

SEQ ID NO: 1026275 - protein, 610 aa, Homo sapiens
RIPRAGAGALGCRGGSRLGCWARGQAGRERLRRRRIAQRAVAWAGRTMAAPEPAPRRAREREREREDESEDESDILEESPCGRWQKRREQVNQGNMPGLQSTFLAMDTEEGVEVVWNELHFGDRKAFAAHEEKIQTVFEQLVLVDHPNIVKLHKYWLDTSEACARVIFITEYVSSGSLKQFLKKTKKNHKAMNARVWGAGWGSHGDRTGLGQPRGLGWCGGARRPRTGAGRGCGAGSAGPAASPAPTRPTESCVRRQAWKRWCTQILSALSFLHACSPPIIHGNLTSDTIFIQHNGLIKIGSVWHRIFSNALPDDLRSPIRAEREELRNLHFFPPEYGEVADGTAVDIFSFGMCALEMAVLEIQTNGDTRVTEEAIARARHSLSDPNMREFILCCLARDPARRPSAHSLLFHRVLFEVHSLKLLAAHCFIQHQYLMPENVVEEKTKAMDLHAVLAELPRPRRPPLQWRYSEVSFMELDKFLEDVRNGIYPLMNFAATRPLGLPRVLAPPPEEVQKAKTPTPEPFDSETRKVIQMQCNLERSEDKARWHLTLLLVLEDRLHRQLTYDLLPTDSAQDLASELVHYGFLHEDDRMKLAAFLESTFLKYRGTQA

SEQ ID NO: 1026276 - protein, 562 aa, Homo sapiens
ERGGWKPLRGPSRPANQPPLDPFGLALALGLPEGQSPAQDHLPMPLDSAASFLGIPLDPLKPAPNPLSPALGEEPLAPGGSYPPSPTFPQVAQGLQPTLGPTGQVNQGNMPGLQSTFLAMDTEEGVEVVWNELHFGDRKAFAAHEEKIQTVFEQLVLVDHPNIVKLHKYWLDTSEACARVIFITEYVSSGSLKQFLKKTKKNHKAMNARAWKRWCTQILSALSFLHACSPPIIHGNLTSDTIFIQHNGLIKIGSVWHRIFSNALPDDLRSPIRAEREELRNLHFFPPEYGEVADGTAVDIFSFGMCALEMAVLEIQTNGDTRVTEEAIARARHSLSDPNMREFILCCLARDPARRPSAHSLLFHRVLFEVHSLKLLAAHCFIQHQYLMPENVVEEKTKAMDLHAVLAELPRPRRPPLQWRYSEVSFMELDKFLEDVRNGIYPLMNFAATRPLGLPRVLAPPPEEVQKAKTPTPEPFDSETRKVIQMQCNLERSEDKARWHLTLLLVLEDRLHRQLTYDLLPTDSAQDLASELVHYGFLHEDDRMKLAAFLESTFLKYRGTQA

SEQ ID NO: 1026277 - protein, 680 aa, Homo sapiens; identical to SEQ ID NO: 1026272

SEQ ID NO: 1026278 - protein, 680 aa, Homo sapiens; identical to SEQ ID NO: 1026272

SEQ ID NO: 1026279 - protein, 425 aa, Homo sapiens
MGEDAAQAEKFQHPGSDMRQEKPSSPSPMPSSTPSPSLNLGNTEEAIRDNSQVNAVTVLTLLDKLVNMLDAVQENQHKMEQRQISLEGSVKGIQNDLTKLSKYQASTSNTVSKLLEKSRKVSAHTRAVKERMDRQCAQVKRLENNHAQLLRRNHFKVLIFQEENEIPASVFVKQPVSGAVEGKEELPDENKSLEETLHTVDLSSDDDLPHDEEALEDSAEEKVEESRAEKIKRSSLKKVDSLKKAFSRQNIEKKMNKLGTKIVSVERREKIKKSLTSNHQKISSGKSSPFKVSPLTFGRKKVREGESHAENETKSEDLPSSEQMPNDQEEESFAEGHSEASLASALVEGEIAEEAAEKATSRGSNSGMDSNIDLTIVEDEEEESVALEQAQKVRYEGSYALTSEEAERSDGDPVQPAVLQVHQTS

SEQ ID NO: 1026280 - protein, 294 aa, Homo sapiens
MDRQCAQVKRLENNHAQLLRRNHFKVLIFQEENEIPASVFVKQPVSGAVEGKEELPDENKSLEETLHTVDLSSDDDLPHDEEALEDSAEEKVEESRAEKIKRSSLKKVDSLKKAFSRQNIEKKMNKLGTKIVSVERREKIKKSLTSNHQKISSGKSSPFKVSPLTFGRKKVREGESHAENETKSEDLPSSEQMPNDQEEESFAEGHSEASLASALVEGEIAEEAAEKATSRGSNSGMDSNIDLTIVEDEEEESVALEQAQKVRYEGSYALTSEEAERSDGDPVQPAVLQVHQTS

SEQ ID NO: 1026281 - protein, 375 aa, Homo sapiens [sequence omitted]

SEQ ID NO: 1026282 - protein, 242 aa, Homo sapiens
MGEDAAQAEKFQHPGSDMRQEKPSSPSPMPSSTPSPSLNLGNTEEAIRDNSQVNAVTVLTLLDKLVNMLDAVQENQHKMEQRQISLEGSVKGIQNDLTKLSKYQASTSNTVSKLLEKSRKVSAHTRAVKERMDRQCAQVKRLENNHAQLLRRNHFKVLIFQEENEIPASVFVKQPVSGAVEGKEELPDENKSLEETLHTVDLSSDDDLPHDEEALEDSAEEKVEESRAEKIKKVSQPLRKVG

SEQ ID NO: 1026283 - protein, 425 aa, Homo sapiens; identical to SEQ ID NO: 1026279

SEQ ID NO: 1026284 - protein, 114 aa, Homo sapiens [sequence omitted]

SEQ ID NO: 1026285 - protein, 241 aa, Homo sapiens
MGFCHVGQDGLELTSGDPPTGLPKCWDYRCEPLCPASFYFVNGVFDRYQMVIFMKHSWSVYGGSGIWPHVRVPVFNHELDTALFRATVTTCGEKCSPHHPREAPTRHPREAPMQTFRRRFHCSSENGPRPPWAPPCHQGLWLLPVHRDRQPGLEGAGHGFGCLRWVETRSALAGRALTSRYPVPLCGPGRLVLPAGRKLQELRVAVIWRMSRSSPGGRGAEAFNIIRSNTWLRQAHFPSLQ

SEQ ID NO: 1026286 - protein, 92 aa, Homo sapiens
LGSGMSPLLCRPWHLLGGAPNWTQQEEPEPAQKGSRGRASGPEYGPAAEAARAGPPGPTGVAGFFGASGRAGGLLGQGWTLGPGAAAVSSKP

SEQ ID NO: 1026287 - protein, 92 aa, Homo sapiens; identical to SEQ ID NO: 1026286

SEQ ID NO: 1026288 - protein, 250 aa, Homo sapiens [sequence omitted]

SEQ ID NO: 1026289 - protein, 250 aa, Homo sapiens [sequence omitted]

SEQ ID NO: 1026290 - protein, 250 aa, Homo sapiens [sequence omitted]

SEQ ID NO: 1026291 - protein, 250 aa, Homo sapiens [sequence omitted]

SEQ ID NO: 1026292 - protein, 250 aa, Homo sapiens [sequence omitted]

SEQ ID NO: 1026293 - protein, 178 aa, Homo sapiens
HHATNGVVHLINKVISTITNNIQQFYSLEGAPYCEGCYTDTLEKCNTCGEPITDRMLRATGQGYHPHCFTCVVCARPLGGTSFIAGPGHPAPLLSPTTTRRPPRRCSVCSAPLMPEPAPPPPAPPRRPGTPPSPCPVPPSAALPPPPPPRGRLPLPATPCPAPLPRPPSPRPPPPPPP

SEQ ID NO: 1026294 - protein, 590 aa, Homo sapiens
GRSVSSIDVEIDSLSSLAGMDMTKNDPIQEARAVIWICAPDQWSSSHVSCPSRSTKPAAGGTVTPGLLGTVPFAGSQPLPQVPAPGSVARDSATVHAPSAQLPRALRSQLHVQSQDASLCALASTQPRGGPRHSSPVPAPKFTPVTPKFTPVASKFMSLGDPEVDRGIYEPKSIEWGHPEALSAGTGSPQSPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQRVLHVCDGVRLYCSGRVTTVRSALCVGMCVGVSLVQVWATAKSCMWWCRVPLSTPSYLYVPPLGTSPGRNAVSNTGGEEAAVQLNRRMPRTAATWVQRALNSTRRRACFELMMLVILAGLGNPLWNECSRVSIREVARAQTRVHTLGVPHDRKPRRLDSSTREVSIAILGYWMPHYAESVVPEDVKHVAAVWVRPEKPRKRIATAQVLYHRLLTRTRERAPHGPNWTSSIDELRMTIAAFDSVPRMATDTRKDSHHVGLVRPQETKVECDYVTRYRNPKLTIASDMLD

SEQ ID NO: 1026295 - protein, 457 aa, Homo sapiens
GRSVSSIDVEIDSLSSLAGMDMTKNDPIQEARAVIWICAPDQWSSSHVSCPSRSTKPAAGGTVTPGLLGTVPFAGSQPLPQVPAPGSVARDSATVHAPSAQLPRALRSQLHVQSQDASLCALASTQPRGGPRHSSPVPAPKFTPVTPKFTPVASKFMSLGDPEVDRGIYEPKSIEWGHPEALSAGTGSPQSPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGQGYHPHCFTCVVCARPLGGTSFIAGPGHPAPLLSPTTTRRPPRRCSVCSAPLMPEPAPPPPAPPRRPGTPPSPCPVPPSAALPPPPPPRGRLPLPATPCPAPLPRPPSPRPPPPPPP

SEQ ID NO: 1026296 - protein, 241 aa, Homo sapiens
MLGLQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGQGYHPHCFTCVVCARPLGGTSFIAGPGHPAPLLSPTTTRRPPRRCSVCSAPLMPEPAPPPPAPPRRPGTPPSPCPVPPSAALPPPPPPRGRLPLPATPCPAPLPRPPSPRPPPPPPP

SEQ ID NO: 1026297 - protein, 100 aa, Homo sapiens
SGSPTAPCCGSQQLGRREEWQRQGSPVSRRLSARRGPQAPGTRLPRRHPARAFPAATMPKRKVSSAEGAAKEEPKRRSARLSAKPPAKVEAKPKKGSSEG

SEQ ID NO: 1026298 - protein, 69 aa, Homo sapiens
GNRGAKGKQCLKWLTKKLKKTYHAATMPKRKVSSAEGAAKEEPKRRSARLSAKPPAKVEAKPKKGSSEG

SEQ ID NO: 1026299 - protein, 100 aa, Homo sapiens; identical to SEQ ID NO: 1026297

SEQ ID NO: 1026300 - protein, 100 aa, Homo sapiens; identical to SEQ ID NO: 1026297

SEQ ID NO: 1026301 - protein, 100 aa, Homo sapiens; identical to SEQ ID NO: 1026297

SEQ ID NO: 1026302 - protein, 100 aa, Homo sapiens; identical to SEQ ID NO: 1026297

SEQ ID NO: 1026303 - protein, 100 aa, Homo sapiens; identical to SEQ ID NO: 1026297

SEQ ID NO: 1026304 - protein, 100 aa, Homo sapiens; identical to SEQ ID NO: 1026297

SEQ ID NO: 1026305 - protein, 113 aa, Homo sapiens
MSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 1026306 - protein, 129 aa, Homo sapiens
SGPQSLSRRRGFSSLPLEPPRFPTFRSPLPAFSRHRRRRLPQAVSTEEKESYRMSAIQNLHSFGKLWERSRARVGQRGLPGPETCSGKLPSAPGLRKLGQGKLDQGRRAAGSRPGPRGRTLSATGRSRR

SEQ ID NO: 1026307 - protein, 113 aa, Homo sapiens; identical to SEQ ID NO: 1026305

SEQ ID NO: 1026308 - protein, 113 aa, Homo sapiens; identical to SEQ ID NO: 1026305

SEQ ID NO: 1026309 - protein, 126 aa, Homo sapiens
SGPQSLSRRRGFSSLTEEKESYRMSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFPRRDWTG

SEQ ID NO: 1026310 - protein, 139 aa, Homo sapiens
EGFTSPAHLEPSFRRRSPAAFPHALRFAWRSPRKDRSYVVSRPPSFDPFADASKGDDLLPAGTEDYIHIRIQQRNGRKTLTTVQGIADDYDKKKLVKAFKKKFACNGTVIEHPEYGEVIQLQGDQRKNICQFPRRDWTG

SEQ ID NO: 1026311 - protein, 113 aa, Homo sapiens; identical to SEQ ID NO: 1026305

SEQ ID NO: 1026312 - protein, 113 aa, Homo sapiens; identical to SEQ ID NO: 1026305

SEQ ID NO: 1026313 - protein, 126 aa, Homo sapiens; identical to SEQ ID NO: 1026309

SEQ ID NO: 1026314 - protein, 139 aa, Homo sapiens
AAVRLGRPPSREYDPPAALRTRALRGVFTEEKESYRMSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFPRRDWTG

SEQ ID NO: 1026315 - protein, 113 aa, Homo sapiens; identical to SEQ ID NO: 1026305

SEQ ID NO: 1026316 - protein, 132 aa, Homo sapiens
SGPQSLSRRRGFSSLPLEPPRFPTFRSPLPAFSRHRRRRLPQAVSTEEKESYRMSAIQNLHSFGKLWERSRARVGQRGLPGPETCSGKLPSAPGLRKLGQGKLDQGRRAAGSRPGPRGRTLSATGRSRRPLC

SEQ ID NO: 1026317 - protein, 122 aa, Homo sapiens
SGPQSLSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFKKVGLQ

SEQ ID NO: 1026318 - protein, 113 aa, Homo sapiens; identical to SEQ ID NO: 1026305

SEQ ID NO: 1026319 - protein, 113 aa, Homo sapiens; identical to SEQ ID NO: 1026305

SEQ ID NO: 1026320 - protein, 228 aa, Homo sapiens
SGPQSLSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFPRRVEVQSLLDLCLSAGKSQILSVSFCWGHKSWLCKAEQNLSWVLKYIDLFLFYRKKQKGLVYLWFTVSVDLLHRCKFE

SEQ ID NO: 1026321 - protein, 118 aa, Homo sapiens
RAEFGTSTEEKESYRMSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFPRRDWTG

SEQ ID NO: 1026322 - protein, 139 aa, Homo sapiens; identical to SEQ ID NO: 1026310

SEQ ID NO: 1026323 - protein, 129 aa, Homo sapiens; identical to SEQ ID NO: 1026306

SEQ ID NO: 1026324 - protein, 118 aa, Homo sapiens; identical to SEQ ID NO: 1026321

SEQ ID NO: 1026325 - protein, 68 aa, Homo sapiens
EGFSSPAHLEPSFRRRSPAAFPHALRFAWRSPRKDSFVCSYPDLPLSNSIYDAMLMLVMTCRVAEIII

SEQ ID NO: 1026326 - protein, 156 aa, Homo sapiens
SGPQSLSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFPRRDWTG

SEQ ID NO: 1026327 - protein, 124 aa, Homo sapiens
MLLLGLIRFPLCLQKFACNGTVIEHPEYGEVIQLQGDQRKNICQFPRRVEVQSLLDLCLSAGKSQILSVSFCWGHKSWLCKAEQNLSWVLKYIDLFLFYRKKQKGLVYLWFTVSVDLLHRCKFE

SEQ ID NO: 1026328 - protein, 113 aa, Homo sapiens; identical to SEQ ID NO: 1026305

SEQ ID NO: 1026329 - protein, 113 aa, Homo sapiens; identical to SEQ ID NO: 1026305

SEQ ID NO: 1026330 - protein, 113 aa, Homo sapiens; identical to SEQ ID NO: 1026305

SEQ ID NO: 1026331 - protein, 113 aa, Homo sapiens; identical to SEQ ID NO: 1026305

SEQ ID NO: 1026332 - protein, 113 aa, Homo sapiens; identical to SEQ ID NO: 1026305

SEQ ID NO: 1026333 - protein, 113 aa, Homo sapiens; identical to SEQ ID NO: 1026305

SEQ ID NO: 1026334 - protein, 113 aa, Homo sapiens; identical to SEQ ID NO: 1026305

SEQ ID NO: 1026335 - protein, 113 aa, Homo sapiens; identical to SEQ ID NO: 1026305

SEQ ID NO: 1026336 - protein, 113 aa, Homo sapiens; identical to SEQ ID NO: 1026305

SEQ ID NO: 1026337 - protein, 113 aa, Homo sapiens; identical to SEQ ID NO: 1026305

SEQ ID NO: 1026338 - protein, 129 aa, Homo sapiens; identical to SEQ ID NO: 1026306

SEQ ID NO: 1026339 - protein, 168 aa, Homo sapiens
RTLRTLAWWQMWLPAAELPVPLSPQRPGHFLHVSPAHVNCRENQGSLRAAWRRHQTPGVPTWAPHPPHAQARLGVGTGGVVSGSWFLDLASEGYKGGCTSKWPNRFEEGALRGVCTFCAGCSSRTEELFLHVFLNSMAMEQVKATPWGLAQHIKDDFSRTPDLIPTFP

SEQ ID NO: 1026340 - protein, 206 aa, Homo sapiens
PREFPKARKPSRAPLAMETVISSDSSPAVENEHPQALVTKGVRAAPLWDSKKQSFVGMLNINDINILHRYYKLVKYGLKIENWVIKYFKVISPYCQAGVEAGPLPLIRKQESHKLPVIEPRIQAITLYILTHKRILKFLKLFITEFPKAKVHVPSLWKSYRFGTYANIAMVRTTTPVYVALGIFVQHRVSALQWWMRRGRVGGQST

SEQ ID NO: 1026341 - protein, 248 aa, Homo sapiens
PREFPKARKPSRAPLAMETVISSDSSPAVENEHPQETPESNNSVYTSFMKSHRCYDLIQKSSKLVVFDTSLQVKKAFFALVTKGVRAAPLWDSKKQSFVGMLTINDINILHRYYKLVKYGLKIENWVIKEFKVISPNARLVWMLVLFINSGNKIHKLPVIEPRIQAITLYILTHKRILKFLKLFITEFPKAKVHVPSLWKSYRFGTYANIAMVRTTTPVYVALGIFVQHRVSALQWWMRRGRVGGQST

SEQ ID NO: 1026342 - protein, 96 aa, Homo sapiens
PREFPKARKPSRAPLAMETVISSDSSPAVENEHPQETPESNNSVYTSFMKSHRCYDLIQKSSKLVVFDTSLQVKKAFFGLWVDLTGVTEPAPLIRD

SEQ ID NO: 1026343 - protein, 103 aa, Homo sapiens
MTGGYSMNFNMSSSRGPLPVKRGPPPRSGGPPPKRSALQDQFAVAGEWGGRAPVSRGKKIVMEVHLEGKRWPLVETCNWSQEMTGNNIKTVIQERITSSGTQD

SEQ ID NO: 1026344 - protein, 103 aa, Homo sapiens; identical to SEQ ID NO: 1026343

SEQ ID NO: 1026345 - protein, 179 aa, Homo sapiens
MVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 1026346 - protein, 170 aa, Homo sapiens
AGPRLPIRQSAADGLRARPLGSNTAPALRVMVQAWYMDDAPGDPRQPHRPDPGRPVGLEQLRRLGVLYWKLDADKYENDPELEKIRRERNYSWMDIITICKDKLPHPGWQWVLRCEGQGGPVDPDLHGEGRHGDAPRGDLSPLHGGREELHEGHAAVCGRTGVDSVQPAR

SEQ ID NO: 1026347 - protein, 134 aa, Homo sapiens
AGPRLPIRQSAADGLRARPLGSNTAPALRVMVQAWYMDDAPGDPRQPHRPDPGRPVGLEQLRRLGVLYWKLDADKYENDPELEKIRRERNYSWMDIITICKDKLPNFEVHSECDWALSCKVLGGLSDSATYGPS

SEQ ID NO: 1026348 - protein, 187 aa, Homo sapiens
PKGPGCVAPCPAGIGRSTAKTPGPPGSQKCRSLHSGSLTSCNTGVCCSLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 1026349 - protein, 209 aa, Homo sapiens
AGPRLPIRQSAADGLRARPLGSNTAPALRVMVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 1026350 - protein, 179 aa, Homo sapiens; identical to SEQ ID NO: 1026345

SEQ ID NO: 1026351 - protein, 179 aa, Homo sapiens; identical to SEQ ID NO: 1026345

SEQ ID NO: 1026352 - protein, 179 aa, Homo sapiens
SASGRHNDCVVSCIDEPATGTTPTGAVAEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 1026353 - protein, 213 aa, Homo sapiens
AGPRLPIRQSAADGLRARPLGSNTAPALRVMVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTASPAV

SEQ ID NO: 1026354 - protein, 136 aa, Homo sapiens
MRTPGPLPVLLLLLAGAPAARPTPPTCYSRMRALSQEITRDFNLLQVSEPSEPCVRYLPRLYLDIHNYCVLDKLRDFVASPPCWKVAQVDSLKDKARKLYTIMNSFCRRDLVFLLDDCNALEYPIPVTTVLPDRQR

SEQ ID NO: 1026355 - protein, 76 aa, Homo sapiens
GRGCTSAWHHEDAWASARAAAAPGGSPRRAAHSPDLLLPHAGPEPGDHPRLQPPAGLGALGYSCWMTAMPWNTQSQ

SEQ ID NO: 1026356 - protein, 59 aa, Homo sapiens
MCEIPAQAVPGHTQLLCAGQAAGLCGLAPVLESGPGRFLEGQSTEAVHHHELVLQERFG

SEQ ID NO: 1026357 - protein, 75 aa, Homo sapiens
DILVKVSLKKEEAVDGDVVLQVRGMRCGKVEDKKKRDNPEDVSSRLGRSGGKPLHRKQQGTGDIFLGVDRSVQAL

SEQ ID NO: 1026358 - protein, 75 aa, Homo sapiens; identical to SEQ ID NO: 1026357

SEQ ID NO: 1026359 - protein, 75 aa, Homo sapiens; identical to SEQ ID NO: 1026357

SEQ ID NO: 1026360 - protein, 140 aa, Homo sapiens
GRMDGRGPRCFLTRRCLLSSVITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 1026361 - protein, 548 aa, Homo sapiens
MILRGCQERCSVSDRYLLQVEICTSRSPEQSSARVVEDGATLPRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRQGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKAGVRWCHLGSLQAPASRVQDGSPCLSLPSELGFQVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 1026362 - protein, 302 aa, Homo sapiens
MILRGCQERCSVSDRYLLQVEICTSRSPEQSSARVVEDGATLPRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRQGGPPGPTRPLTSSSAKLPKSLSSPGGPSKPKKSKSGQDPQQEQEQERERDPQQEQERERPVDREPVDREPGGVPPRPGGAAAGLASGAA

SEQ ID NO: 1026363 - protein, 146 aa, Homo sapiens
EPLQALVSLHATQSADPPPPPSPRPSSGDPSRVKAGHKHVGTGRANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 1026364 - protein, 409 aa, Homo sapiens
MILRGCQERCSVSDRYLLQVEICTSRSPEQSSARVVEDGATLPRSREGPENMVRIALQLDDGSRLQDSFCSGQTLWELLSHFPQIRECLQHPGGATPVCVYTRDEVTGEAALRGTTLQSLGLTGGSATISSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 1026365 - protein, 537 aa, Homo sapiens
MILRGCQERCSVSDRYLLQVEICTSRSPEQSSARVVEDGATLPRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRQGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVAGSAGGSGGTSRGGTHHSVSSPPHRYMSRAAGSPSPLPAPDPAPKSEPAAEEGALVPPEPIPGTAQPVKRSLGKVPKWLKLPASKR

SEQ ID NO: 1026366 - protein, 514 aa, Homo sapiens
MILRGCQERCSVSDRYLLQVEICTSRSPEQSSARVVEDGATLPRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRQGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 1026367 - protein, 117 aa, Homo sapiens
MILRGCQERCSVSDRYLLQVEICTSRSPEQSSARVVEDGATLPRSREGPENMVRIALQLDDGSRLQDSFCSGQTLWKRGLFFFQKGPMSFSAIFHRSGSACSTPAGPPQSACTRGMR

SEQ ID NO: 1026368 - protein, 323 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPICLQHIPRHRIRPGRDPSILQCLCFLKPATACDSYPSSSFFCQLKPSSATSAGSLLWQASPLIDFLVFSLDGTGMGLSGGGRGPWGRAGMGDLLACGPHLPLCSLPSHPPAQLLTYPHIPGLG

SEQ ID NO: 1026369 - protein, 261 aa, Homo sapiens [sequence omitted]

SEQ ID NO: 1026370 - protein, 161 aa, Homo sapiens
ENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 1026371 - protein, 190 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANW

SEQ ID NO: 1026372 - protein, 258 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFLATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANW

SEQ ID NO: 1026373 - protein, 204 aa, Homo sapiens
MPGKHQHFQEPEVGCCGKYFLFGFNIVFWFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANW

SEQ ID NO: 1026374 - protein, 270 aa, Homo sapiens; identical to SEQ ID NO: 754354

SEQ ID NO: 1026375 - protein, 562 aa, Homo sapiens
EHTLALASNGGVYAWGSNSEGQLGLGHTNHVREPTLVTGHAKGKMFGRSRLAAATVLHGQHHLSHQEHQVCQYLLQLGLPDTVPPQYGALREVSIHTVRARLRLLYHFSDLMYSSWRLLNLSPNNQNSTSHYNAGTWGIVQGQLRPLLAPRVYTLPMVRSIGKTMVQGKNYGPQITVKRISTRGRKCKPIFVQIARQVVKLNASDLRLPSRAWKVKLVGEGADDAGGVFDDTITEMCQELETGIVDLLIPSPNATAEVGYNRDRFLFNPSACLDEHLMQFKFLGILMGVAIRTKKPLDLHLAPLVWKQLCCVPLTLEDLEEVDLLYVQTLNSILHIEDSGITEESFHEMIPLDSFVGQSADGKMVPIIPGGNSIPLTFSNRKEYVERAIEYRLHEMDRQVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINNCRSIDMDNYMLSRNVDNAEGSDTDY

SEQ ID NO: 1026376 - protein, 178 aa, Homo sapiens
FPFPVPHPLSPTLILVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINNCRSIDMDNYMLSRNVDNAEGSDTDY

SEQ ID NO: 1026377 - protein, 156 aa, Homo sapiens
MSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLVMAERLRYAINNCRSIDMDNYMLSRNVDNAEGSDTDY

SEQ ID NO: 1026378 - protein, 123 aa, Homo sapiens
CCPWRGREREGGQRGSHGQLHLTVVLSILPALWGHPCSWLPVCTLLVDGYEGQVPSYYTLILCQALCVVYSLKQSCQSELLLTLHTQALEEVRTRRNIFTQSLEGHGAVGPQLILSGPVSVST

SEQ ID NO: 1026379 - protein, 276 aa, Homo sapiens [sequence omitted]

SEQ ID NO: 1026380 - protein, 488 aa, Homo sapiens
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISEATKAGAASMIHYMVLISARLVLLTLCGWVLCWTLVNLFRSHSVLNLLFLGYPFGVYVPLCCFHQDSRAHLLLTDYNYVVQHEAVEESASTVGGLAKSKDFLSLLLESLKEQFNNATPIPTHSCPLSPDLIRNEVECLKADFNHRIKEVLFNSLFSAYYVAFLPLCFVKSTQYYDMRWSCEHLIMVWINAFVMLTTQLLPSKYCDLLHKSAAHLGKWQKLEHGSYSNAPQHIWSENTIWPQGVLVRHSRCLYRAMGPYNVAVPSDVSHARFYFLFHRPLRLLNLLILIEGSVVFYQLYSLLRSEKWNHTLSMALILFCNYYVLFKLLRDRIVLGRAYSYPLNSYELKAN

SEQ ID NO: 1026381 - protein, 339 aa, Homo sapiens
MGAYSLNSFFSSTCWLLFSFSTSTFIKQCGGILTIILLLVHHWFGVYVPLCCFHQDSRAHLLLTDYNYVVQHEAVEESASTVGGLAKSKDFLSLLLESLKEQFNNATPIPTHSCPLSPDLIRNEVECLKADFNHRIKEVLFNSLFSAYYVAFLPLCFVKSTQYYDMRWSCEHLIMVWINAFVMLTTQLLPSKYCDLLHKSAAHLGKWQKLEHGSYSNAPQHIWSENTIWPQGVLVRHSRCLYRAMGPYNVAVPSDVSHARFYFLFHRPLRLLNLLILIEGSVVFYQLYSLLRSEKWNHTLSMALILFCNYYVLFKLLRDRIVLGRAYSYPLNSYELKAN

SEQ ID NO: 1026382 - protein, 488 aa, Homo sapiens; identical to SEQ ID NO: 1026380

SEQ ID NO: 1026383 - protein, 488 aa, Homo sapiens; identical to SEQ ID NO: 1026380

SEQ ID NO: 1026384 - protein, 525 aa, Homo sapiens
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISEVCVCKLLIFRNPISGSRVTGNTKSRSENHLKLTKKQQATKAGAASMIHYMVLISARLVLLTLCGWVLCWTLVNLFRSHSVLNLLFLGYPFGVYVPLCCFHQDSRAHLLLTDYNYVVQHEAVEESASTVGGLAKSKDFLSLLLESLKEQFNNATPIPTHSCPLSPDLIRNEVECLKADFNHRIKEVLFNSLFSAYYVAFLPLCFVKSTQYYDMRWSCEHLIMVWINAFVMLTTQLLPSKYCDLLHKSAAHLGKWQKLEHGSYSNAPQHIWSENTIWPQGVLVRHSRCLYRAMGPYNVAVPSDVSHARFYFLFHRPLRLLNLLILIEGSVVFYQLYSLLRSEKWNHTLSMALILFCNYYVLFKLLRDRIVLGRAYSYPLNSYELKAN

SEQ ID NO: 1026385 - protein, 488 aa, Homo sapiens; identical to SEQ ID NO: 1026380

SEQ ID NO: 1026386 - protein, 361 aa, Homo sapiens [sequence omitted]

SEQ ID NO: 1026387 - protein, 362 aa, Homo sapiens
MNVHCYGKKLKSSDNEFTISNVPLELCLLLRVLTILLTKVISYIDEVIRCDFRWYLWSHFHTLFYRFGVYVPLCCFHQDSRAHLLLTDYNYVVQHEAVEESASTVGGLAKSKDFLSLLLESLKEQFNNATPIPTHSCPLSPDLIRNEVECLKADFNHRIKEVLFNSLFSAYYVAFLPLCFVKSTQYYDMRWSCEHLIMVWINAFVMLTTQLLPSKYCDLLHKSAAHLGKWQKLEHGSYSNAPQHIWSENTIWPQGVLVRHSRCLYRAMGPYNVAVPSDVSHARFYFLFHRPLRLLNLLILIEGSVVFYQLYSLLRSEKWNHTLSMALILFCNYYVLFKLLRDRIVLGRAYSYPLNSYELKAN

SEQ ID NO: 1026388 - protein, 80 aa, Homo sapiens
MDGGKVKLKHKVPISNGTQMIRWGFNIGVSGTGVSGAQRKIQDSLKWQKPPKVTFLYCHDELELPEKFKKIETLINGVEK

SEQ ID NO: 1026389 - protein, 125 aa, Homo sapiens
MACARPLISVYSEKGESSGKNVTLPAVFKAPIRPDIVNFVHTNLRKNNRQPYAVSELAGHQTSAESWGTGRAVARIPRVSDVLCWYFYSLCATVSSFGENIVMSLGGRIVFGHPPKNLCAVLHLL

SEQ ID NO: 1026390 - protein, 232 aa, Homo sapiens [sequence omitted]

SEQ ID NO: 1026391 - protein, 244 aa, Homo sapiens
MRNRRRIQRRGPCIIYNEDNGIIKAFRNIPGITLLNVSKLNILKLAPGGHVGRFCIWTESAFRKLDELYGTWRKAASLKSNYNLPMHKMINTDLSRILKSPEIQRALRAPRKKIHRRVLKKNPLKNLRIMLKLNPYAKTMRRNTILRQARNHKLRVDKAAAAAAALQAKSDEKAAVAGKKPVVGKKGKKAAVGVKKQKKPLVGKKAAATKKPAPVYYVYVSVSMYVYVYVCCYIYVCVCICICL

SEQ ID NO: 1026392 - protein, 207 aa, Homo sapiens
MRNRRRIQRRGPCIIYNEDNGIIKAFRNIPGITLLNVSKLNILKLAPGGHVGRFCIWTESAFRKLDELYGTWRKAASLKSNYNLPMHKMINTDLSRILKSPEIQRALRAPRKKIHRRVLKKNPLKNLRIMLKLNPYAKTMRRNTILRQARNHKLRVDKAAAAAAALQAKSDEKAAVAGKKPVVGKKGGLLWLRAERPRWKRNLPGPA

SEQ ID NO: 1026393 - protein, 139 aa, Homo sapiens
MACARPLISVYSEKGESSGKNVTLPAVFKAPIRPDIVNFVHTNLRKNNRQPYAVSELAGHQTSAESWGTGRAVARIPRVRGGGTHRSGQGAFGNMCRGGRMFAPTKTWRRWHRRVNTTQKRYAICSALVCLSPTSTGHV

SEQ ID NO: 1026394 - protein, 232 aa, Homo sapiens [sequence omitted]

SEQ ID NO: 1026395 - protein, 232 aa, Homo sapiens [sequence omitted]

SEQ ID NO: 1026396 - protein, 232 aa, Homo sapiens [sequence omitted]

SEQ ID NO: 1026397 - protein, 139 aa, Homo sapiens; identical to SEQ ID NO: 1026393

SEQ ID NO: 1026398 - protein, 112 aa, Homo sapiens
MACARPLISVYSEKGESSGKNVTLPAVFKAPIRPDIVNFVHTNLRKNNRQPYAVSELAGHQTSAESWGTGRAVARIPRVRGGGTHRSAQDAIGNVSWRPNVCTNQNLAPLAS

SEQ ID NO: 1026399 - protein, 125 aa, Homo sapiens
MWYSVHLFGVLSDSKHLSTRRWSRKSCDVVSHPCIKVCKLFKAPIRPDIVNFVHTNLRKNNRQPYAVSELAGHQTSAESWGTGRAVARIPTVVGLTASGQVLLETCVVEAECLHQPKPGAVGIVE

SEQ ID NO: 1026400 - protein, 232 aa, Homo sapiens [sequence omitted]

SEQ ID NO: 1026401 - protein, 218 aa, Homo sapiens
MRNRRRIQRRGPCIIYNEDNGIIKAFRNIPGITLLNVSKLNILKLAPGGHVGRFCIWTESAFRKLDELYGTWRKAASLKSNYNLPMHKMINTDLSRILKSPEIQRALRAPRKKIHRRVLKKNPLKNLRIMLKLNPYAKTMRRNTILRQARNHKLRVDKAAAAAAALQAKSDEKAAVAGKKPVVGKKGKKAAVGVKKQKKPLVGARCASLLPSAFKVLV

SEQ ID NO: 1026402 - protein, 139 aa, Homo sapiens; identical to SEQ ID NO: 1026393

SEQ ID NO: 1026403 - protein, 226 aa, Homo sapiens
MVSSRPSETSLELLSLLTLSRVIPGMFLLNVSKLNILKLAPGGHVGRFCIWTESAFRKLDELYGTWRKAASLKSNYNLPMHKMINTDLSRILKSPEIQRALRAPRKKIHRRVLKKNPLKNLRIMLKLNPYAKTMRRNTILRQARNHKLRVDKAAAAAAALQAKSDEKAAVAGKKPVVGKKGKKAAVGVKKQKKPLVGKKAAATKKPAPEKKPAEKKPTTEEKKPAA

SEQ ID NO: 1026404 - protein, 232 aa, Homo sapiens [sequence omitted]

SEQ ID NO: 1026405 - protein, 232 aa, Homo sapiens [sequence omitted]

SEQ ID NO: 1026406 - protein, 232 aa, Homo sapiens [sequence omitted]

SEQ ID NO: 1026407 - protein, 232 aa, Homo sapiens [sequence omitted]

SEQ ID NO: 1026408 - protein, 112 aa, Homo sapiens
MACARPLISVYSEKGESSGKNVTLPAVGVKQKKLRVDKAAAAAAALQAKSDEKAAVAGKKPVVGKKGKKAAVGVKKQKKPLVGKKAAATKKPAPEKKPAEKKPTTEEKKPAA

SEQ ID NO: 1026409 - protein, 100 aa, Homo sapiens
MACARPLISVYSEKGESSGKNVTLPAVFKAPIRPDIVNFVHTNLRKNNRQPYAVSELAGHQTSAESWGTGRAVARIPRVEVWLRLQVFDMFVSDVDTNCL

SEQ ID NO: 1026410 - protein, 139 aa, Homo sapiens; identical to SEQ ID NO: 1026393

SEQ ID NO: 1026411 - protein, 232 aa, Homo sapiens [sequence omitted]

SEQ ID NO: 1026412 - protein, 232 aa, Homo sapiens [sequence omitted]

SEQ ID NO: 1026413 - protein, 144 aa, Homo sapiens [sequence omitted]

SEQ ID NO: 1026414 - protein, 261 aa, Homo sapiens
MLGARVAAHLDALGPLVPYVPPPLLPSMFYVGLFFVNVLILYYAFLMEYIVLNVGLVFLPEDMDQALVDLGVLSDPARAFTMLTRSSTSLMRTWSRVSTAVPLFPTRSGTHALDQPPDHAAELVGGTIWTGMVPQEETLPCLRGLPAPLKSFVPTERFLFEPRRVEERLGLSAEVGKAPAPTEGGTQEASQDLICLQCQIDGLALASDYLQLRWMFTGTQPEFASLHFIPERTCFPHFTFGEDTSNCGHTQKRLPAPFDVS

SEQ ID NO: 1026415 - protein, 261 aa, Homo sapiens; identical to SEQ ID NO: 1026414

SEQ ID NO: 1026416 - protein, 261 aa, Homo sapiens; identical to SEQ ID NO: 1026414

SEQ ID NO: 1026417 - protein, 261 aa, Homo sapiens; identical to SEQ ID NO: 1026414

SEQ ID NO: 1026418 - protein, 289 aa, Homo sapiens
MLGARVAAHLDALGPLVPYVPPPLLPSMFYVGLFFVNVLILYYAFLMEYIVLNVGLVFLPEDMDQALVDLGVLSDPARAFTMLTRSSTSLMRTWSRVSTAVPLFPTRSGTHALDQPPDHAAELVGGTIWTGMVPQEETLPCLRGLPAPLKSFVPTERFLFEPRRVEERLGLSAEVGKAPAPTEGGTQEASQDLICLQCQIDGLALASDYLQLRWMFTGTQPEFASLHFIPERTCFPHFTFGEDTSNCGHTQKRLPAPFDVTRSSASWQNRHHAGECHVTPLAGNAFLKV

SEQ ID NO: 1026419 - protein, 61 aa, Homo sapiens
MSKFTSRCFLDQQQHQEPLTQYSQVHYLNHHHCYPITQYSQLHFFNHHHREPLKQYSQLHF

SEQ ID NO: 1026420 - protein, 213 aa, Homo sapiens
MGSSPQSPLVGSLECLPGVWSLPEDAAFVLSSPSSMAISSQTFSLPLFRLSMVWWPRTFECALCWLITGFGLAVDLITLGWGCRLLPVGLPWNLCLVEMSGPDPVGCRSGTGALVGLGVQSKMLCWGLCSGGSSGLTHCLFLSLHLGMFPEQFKRPTHSPVCSWEPRAQQHQLQPREPRRQLQQGARVAPLGRRRRESTKAPADILYRPMPGY

SEQ ID NO: 1026421 - protein, 205 aa, Homo sapiens
MGSSPQSPLVGSLECLPGVWSLPEDAAFVLSSPSSMAISSQTFSLPLFRLSMVWWPRTFECALCWLITGFGLAVDLITLGWGCRLLPVGLPWNLCLVEMSGPDPVGCRSGTGALVGLGVQSKMLCWGLCSGGSSGLTHCLFLSLHLGMFPEQFKRPTHSPVCSWEPRAQQHQLQPREPRRQLQQGARVAPLNHGLSPVASASGGK

SEQ ID NO: 1026422 - protein, 275 aa, Homo sapiens
MQMKCNWHDPHPQILHLNSHPKKHSYFMHPRSYTHTTHSTRMNTAHTRAQHTHEHTAHTQTHSTHSTQMSTQHTHKRTAHTRTHMHTQHTNARHTHAHTCTHSTHANAQHTLGKAQHTRKKAHTRAHSTQTHSTRTHMHTQHTSTQHTHKDTAHTCTHSTNTRTQHTRTQHNQHTHKHSTHAHSTCTHSTHMNTAHSTHMHTATLSTHEHSTHKHTAHTCTHSTHTHAQYMNTAHSTKTRSTHVAHASSHLHTHPHTHTPTKLDETISYLSTTIS

SEQ ID NO: 1026423 - protein, 275 aa, Homo sapiens; identical to SEQ ID NO: 1026422

SEQ ID NO: 1026424 - protein, 209 aa, Homo sapiens
MQMKCNWHDPHPQILHLNSHPKKHSYFMHPRSYTHTTHSTRMNTAHTRAQHTHEHTAHTQTHSTHSTQMSTQHTHKRTAHTRTHMHTQHTNARHTHAHTCTHSTHANAQHTLGKAQHTRKKAHTRAHSTQTHSTRTHMHTQHTSTQHTHKDTAHTCTHSTNTRTQHTRTQHNQHTHKHSTHAHSTCTHSTHMNTAHSTHMHTATHAQHT

SEQ ID NO: 1026425 - protein, 114 aa, Homo sapiens
MLTRKIKLWDINAHITCRLCSGYLIDATTVTECLHTSQARQKQEPGPGAETILKISQKSHFTLKVLWVVSEQMRPRLGERNTGETPHSSHGAARPVAAVTVLTAGSFQISRGVP

SEQ ID NO: 1026426 - protein, 229 aa, Homo sapiens
MLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDLTGGDLLCTPATRSPSHWGHHSRRQAHTEARANPQQNDTTREQTGDTGMRRSPAQAGRTGDDTRVGPGNAEPNSDAQKPRATGEQHRGTGTHQRHRDKALQPVRHGSALAKAANSNNDSGEA

SEQ ID NO: 1026427 - protein, 173 aa, Homo sapiens
MLTRKIKLWDINAHITCRLCSGYLIDATTVTECLHTCTCPARATQGGRALPSSVLFRTLAFVLPHAFSSSPTKAGTRTRGRDDLEDKSEKSFHAKGPVGGVRADEASLRRAKHRRDPTFLPRSSKASSRCDSAHCWQFPNLQRSSLDPSKGNLPVCSSHLMCVLTPDESVLWC

SEQ ID NO: 1026428 - protein, 229 aa, Homo sapiens; identical to SEQ ID NO: 1026426

SEQ ID NO: 1026429 - protein, 112 aa, Homo sapiens
AQTHTAHAPSAAPPTRRSARLGHFRLFVLNSGRAFFLLLLGGTQRERRPLPPPARTPRAPCSPAAPRPQASQCSRDPRRRAQKMEKEPGPEGGCRSESACGARRQRRVGVLA

SEQ ID NO: 1026430 - protein, 167 aa, Homo sapiens
MLSKRMTAKRRELKPASQARKRMVKERSDCHPAGCDSPPDSPAGAGFGGAAPPAALCAHWAPGPWWPCRLFPRAMRPLHGDELRDDLCLLSGAEGSAMLCPGGGSSSPPPPPPPGARGAGRGPGGGGGGGRKRRREELCALPPSAPRGRRTGGGGSGGGESPPQQRP

SEQ ID NO: 1026431 - protein, 235 aa, Homo sapiens
MARKALPPNPPGPELVLLLLQWTLSWLSRRFGQELQQALLGPARCTAGPLPCCLSSRELLLPGDLIQPDKVPSSGYHCNGPEGKQQHGTAHPAADGLVPAGSPPGTSRPLSHPSMPQPTMDRGIQLPPQTRPLPLSLVTPKVHACYPGPVPALAGQWHDSAGGQSWEIQAITGSRLLSMVAGALQGNQAHAGTPPSAQGLGCLSHTPGRTVDNVGLTKGFLADEGDEHPRSPIVT

SEQ ID NO: 1026432 - protein, 173 aa, Homo sapiens
MARKALPPNPPGPELVLLLLQWTLSWLSRRFGQELQQALLGPARCTAGPLPCCLSSRELLLPGDLIQPDKVPSSGYHCNGPEGKQQHGTAHPAADGLVPAGSPPGTSRPLSQPFHAPAHHGQGYPASSSNSVHLTPERHMNTQGPCLYTQSPCHNTSWVTGMKVLISSLAHPG

SEQ ID NO: 1026433 - protein, 136 aa, Homo sapiens; identical to SEQ ID NO: 778873

SEQ ID NO: 1026434 - protein, 136 aa, Homo sapiens; identical to SEQ ID NO: 778873

SEQ ID NO: 1026435 - protein, 136 aa, Homo sapiens; identical to SEQ ID NO: 778873

SEQ ID NO: 1026436 - protein, 55 aa, Homo sapiens
MATYRVLNGSHGLLVPVPGKLGNLKFTLTQKNNNKDTRTQKPLPGLFGPRKEVCI

SEQ ID NO: 1026437 - protein, 136 aa, Homo sapiens; identical to SEQ ID NO: 778873

SEQ ID NO: 1026438 - protein, 136 aa, Homo sapiens; identical to SEQ ID NO: 778873

SEQ ID NO: 1026439 - protein, 88 aa, Homo sapiens
PGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 1026440 - protein, 88 aa, Homo sapiens; identical to SEQ ID NO: 1026439

SEQ ID NO: 1026441 - protein, 88 aa, Homo sapiens; identical to SEQ ID NO: 1026439

SEQ ID NO: 1026442 - protein, 215 aa, Homo sapiens
HLVCKVARFGHSPQGPCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 1026443 - protein, 75 aa, Homo sapiens
VRGAVVFQSVFPVAGVQLKCESFLGLHAVHRNGLDEDDRHGRGQLFQPRFSDDSSLGVPASPCRDSMAEGQVCCQ

SEQ ID NO: 1026444 - protein, 109 aa, Homo sapiens
MGGAADACFVHGTLIDVLGLHAVHRNGLDEDDRHGRGQLFQPRFSDDSSLGVPASPCRDSMAEGQVCCQYSEGGAGRKGGVLTLPALCRAGLYPKRLQASCHSWKQRPS

SEQ ID NO: 1026445 - protein, 75 aa, Homo sapiens; identical to SEQ ID NO: 1026443

SEQ ID NO: 1026446 - protein, 66 aa, Homo sapiens
EPLLAAYPGWNYINGHPTSNAALFLIERRPHHWPAMKFRSHPDHSTYAEVEPSGHEKEGFMEAEQC

SEQ ID NO: 1026447 - protein, 61 aa, Homo sapiens
MCSYDTWLCALPNPTLALHTSHFKFMMLKDMEDTDDHDDDDDDADDDEDNSLAPTRDQDAW

SEQ ID NO: 1026448 - protein, 175 aa, Homo sapiens
LKAVSSVTVAGEFWGTRAKGLEKARSEPKKKQLCPGEEKLAHSRVEPSFQWKMAGPMFALSPTIAPRGCSYPIVIITFFGRMIPAISVSIRAAERKEAHPGNRYLDQSKSYFEAEVLREKGGKIVFPKRVFSLGHAKIIIPSNPRGWIFQKKANRKVVPPFLHMTDPYYCLTRLE

SEQ ID NO: 1026449 - protein, 118 aa, Homo sapiens
DYSRQTALESTSYIQLPEAELRMERMLPLLALGLLAAGFCPAVLCHPNSPLDEENLTQENQDRGTHVDLGLASANVDFAFSLYKQLVLKAPDKNVIFSPLSISNRLGPSCLWGPIIPP

SEQ ID NO: 1026450 - protein, 318 aa, Homo sapiens
MGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRCYLSKKKWVMVPMMSLHHLTIPYFRDEELSCTVVELKYTGNASALFILPDQDKDGGSGSHAAPRKTLKRWRDSLEFREIGELYLPRSFPILDGDYKPELTYLHPGMGTYEDSLHTAKADLSGTHRAPRNLAVSQVVHKVCLMYLTEGTECRICHSESKVSLLICDVVETRTMVRFRQALRDDHGAEETRQNIFFMSKVSNPSKLELGIKQGASSKELGNELDAG

SEQ ID NO: 1026451 - protein, 336 aa, Homo sapiens
MNELVVTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRCYLSKKKWVMVPMMSLHHLTIPYFRDEELSCTVVELKYTGNASALFILPDQDKDGGSGSHAAPRKTLKRWRDSLEFREIGELYHAQKFFQSRGDYKPELTYLHPGMGTYEDSLHTAKADLSGTHRAPRNLAVSQVVHKVCLMYLTEGTECRICHSESKVSLLICDVVETRTMVRFRQALRDDHGAEETRQNIFFMSKVSNPSKLELGIKQGASSKELGNELDAG

SEQ ID NO: 1026452 - protein, 376 aa, Homo sapiens
DYSRQTALESTSYIQLPEAELRMERMLPLLALGLLAAGFCPAVLCHPNSPLDEENLTQENQDRGTHVDLGLASANVDFAFQPVTKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKKRLVCGYHSGTLWRDCTCTRNFILALAYRTLYQSDLTVEKRLGKRTSGDTHSPRISHSNGTLWTFCQRTTLECSSLDFADLYKSLHNLQNTAPQQTIGRMELLHLFLDPGTRKWHLTSRLQQIPRGVSFTLRTVPSAYTPLLRGAPLFAAMRRPLWHLAPRVSATVSNRLYGSSKATPPVSSLSCPQRVDPLATP

SEQ ID NO: 1026453 - protein, 477 aa, Homo sapiens
DYSRQTALESTSYIQLPEAELRMERMLPLLALGLLAAGFCPAVLCHPNSPLDEENLTQENQDRGTHVDLGLASANVDFAFQPVTKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRCYLSKKKWVMVPMMSLHHLTIPYFRDEELSCTVVELKYTGNASALFILPDQDKDGGSGSHAAPRKTLKRWRDSLEFREIGELYHAQKFFQSRGDYKPELTYLHPGMGTYEDSLHTAKADLSGTHRAPRNLAVSQVVHKVCLMYLTEGTECRICHSESKVSLLICDVVETRTMVRFRQALRDDHGAEETRQNIFFMSKVSNPSKLELGIKQGASSKELGNELDAG

SEQ ID NO: 1026454 - protein, 228 aa, Homo sapiens
PQLTYPPDVAHLSLPYEANYAHLTIPYFRDEELSCTVVELKYTGNASALFILPDQDKDGGSGSHAAPRKTLKRWRDSLEFREIGELYHAQKFFQSRGDYKPELTYLHPGMGTYEDSLHTAKADLSGTHRAPRNLAVSQVVHKVCLMYLTEGTECRICHSESKVSLLICDVVETRTMVRFRQALRDDHGAEETRQNIFFMSKVSNPSKLELGIKQGASSKELGNELDAG

SEQ ID NO: 1026455 - protein, 79 aa, Homo sapiens
ILRPPPALRGTHPQPPTLEVLVTALWELWPSTWLTIQICPWKTCSTDPISLQQSVSRLQEHSHLTLTKKTFRLLCFDCY

SEQ ID NO: 1026456 - protein, 274 aa, Homo sapiens
RWDSSTFERWGVWEPQRQWQEEVRRWWWWAPDDRPVSLTSRLPKTGETIHGHKFFIGFGGKGANQCVQAARLGAMTSMVCKVGKDSFGNDYIENLKQNDISTEFTYQTKDAATGTASIIVNNEVKTLFNPAPAIADLDPQFYTLSDVFCCNESEAEILTGLTVGSAADAGEAALVLLKRGCQVVIITLGAEGCVVLSQTEPEPKHIPTEKVKAVDTTGAGDSFVGALAFYLAYYPNLSLEDMLNRSNFIAAVSVQAAGTQSSYPYKKDLPLTLF

SEQ ID NO: 1026457 - protein, 329 aa, Homo sapiens
RWDSSTFERWGVWEPQRQWQEEVRRWWWWAPDDRPVSLTSRLPKTGETIHGHKFFIGFGGKGANQCVQAARLGAMTSMVCKVGKDSFGNDYIENLKQNDISTEFTYQTKDAATGTASIIVNNEGQNIIVIVAGANLLLNTEDLRAAANVISRAKVMVCQLEITPATSLEALTMARRSGVKTLFNPAPAIADLDPQFYTLSDVFCCNESEAEILTGLTVGSAADAGEAALVLLKRGCQVVIITLGAEGCVVLSQTEPEPKHIPTEKVKAVDTTGAGDSFVGALAFYLAYYPNLSLEDMLNRSNFIAAVSVQAAGTQSSYPYKKDLPLTLF

SEQ ID NO: 1026458 - protein, 329 aa, Homo sapiens; identical to SEQ ID NO: 1026457

SEQ ID NO: 1026459 - protein, 79 aa, Homo sapiens; identical to SEQ ID NO: 1026455

SEQ ID NO: 1026460 - protein, 293 aa, Homo sapiens
RWDSSTFERWGVWEPQRQWQEEVRRWWWWAPDDRPVSLTSRLPKTGETIHGHKFFIGFGGKGANQCVQAARLGAMTSMVCKVGKDSFGNDYIENLKQNDISTEFTYQTKDAATGTASIIVNNEGQNIIVIVAGANLLLNTEDLRAAANVISRAKVMVCQLEITPATSLEALTMARRSGVKTLFNPAPAIADLDPQFYTLSDVFCCNESEAEILTGLTVGSAADAGEAALVLLKRGCQVVIITLGAEGCVVLSQTEPEPKHIPTEKVKAVDTTCRPGSRPKSEAASVKKQKHYK

SEQ ID NO: 1026461 - protein, 300 aa, Homo sapiens
DKTENFEMNNSHQPPTSSSNSQGLWKVPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPPVYSASATTADFQQSHASDSTLLLFPIFIQYCSTG

SEQ ID NO: 1026462 - protein, 456 aa, Homo sapiens
DKTENFEMNNSHQPPTSSSNSQGLWKVPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPPVYSASATTADFQQSHASDSTLLLFPIFIHIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGKAGSLNAADEGPPNCAAEDIKVSSSSV

SEQ ID NO: 1026463 - protein, 300 aa, Homo sapiens; identical to SEQ ID NO: 1026461

SEQ ID NO: 1026464 - protein, 146 aa, Homo sapiens
PSSTFCKVYTITPLLSDNREKRGLALDADNSNATEGTPTACAVPAHREGGCNKEVLGILVSYRVKVKLVVSRGGDVSVELPFVLMHPKPDTSSSRPPSAPETDVPVDTNLIEFDTNYATDDDIVFEDFARLRLKGMKDDDYDDQLC

SEQ ID NO: 1026465 - protein, 116 aa, Homo sapiens
PSSTFCKVYTITPLLSDNREKRGLALDADNSNATDGHTNSLCCPSTSEGGCNKEVLGILVSYRVKVKLVVSRGGDVSVELPFVLMHPKPDTSSSRPPSAPETDVPVDTNLIEFDTK

SEQ ID NO: 1026466 - protein, 106 aa, Homo sapiens
PSSTFCKVYTITPLLSDNREKRGLALDADNSNATDGHTNSLCCPSTSEGGCNKEVLGILVSYRVKVKLVVSRGGDVSVELPFVLMHPKPHDHTPSSSVPPLCFRTA

SEQ ID NO: 1026467 - protein, 94 aa, Homo sapiens
MPLNSTRLNLDMDLNPAGSNGSMVSLVSGASGYSATSTSSFKKGHSLREKLAEMETFRDILCRQVDTLQKYFDACADAVSKDELQRDKVVEDDE

SEQ ID NO: 1026468 - protein, 94 aa, Homo sapiens; identical to SEQ ID NO: 1026467

SEQ ID NO: 1026469 - protein, 215 aa, Homo sapiens
RSCIPTPPSPFSAPPAFLPVVTRESRRGLSSGGSAGRNAGVTATAAAADGWKGRLPSPLVLLPRSARCQARRRRGGRTSSLLLLPPTPERALFASPSPDPSPRGLGASSGAAEGAGAGLLLGCRASMSDNQSWNSSGSEEDPETESGPPVERCGVLSKWTNYIHGWQDRWVVLKNNALSYYKSEDETEYGCRGSICLSKAVITPHDLMNVDLILV

SEQ ID NO: 1026470 - protein, 87 aa, Homo sapiens
MYLFSELWFAFLDCGHHHVTHTSSGKSVQPSLDPLHGDDIQVFGSCVVSTIDYSSYRKTQGNPEFRTRGPTTSSLRHLERRKKEKRT

SEQ ID NO: 1026471 - protein, 196 aa, Homo sapiens
MSPRFPARPWVVKLVASLHEDLHEVSVRSRPSPVPTPGWLGEGVALVDGPPVGDPLSRVPDQCRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLDFGSLSNLQVTQPTVGMNFKTPRGPV

SEQ ID NO: 1026472 - protein, 238 aa, Homo sapiens
VGVLARGLHPPQSSPICSFPRSSAHREALGREGAGALSRLERNWCTAVIPSLKALAARHCLSRALSGSAQHGGPQPGIRPGLGAALFPGRLRWLVSDPVLSTRKGRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLDFGSLSNLQVTQPTVGMNFKTPRGPV

SEQ ID NO: 1026473 - protein, 138 aa, Homo sapiens
MASSLYLLVVNISSGGRCLGDVFSLPVTSIVANHTCCPTLVVLSRQVCYPLAPLRESCLMIARHGCHSFGEQGQFGSSQLQAVRTSRRKLPWYTSHGQYLLMTCGTQNPDNTFEPKIVNTAIGRCCKVCNSHEQQGLL

SEQ ID NO: 1026474 - protein, 138 aa, Homo sapiens; identical to SEQ ID NO: 1026473

SEQ ID NO: 1026475 - protein, 135 aa, Homo sapiens [sequence omitted]

SEQ ID NO: 1026476 - protein, 138 aa, Homo sapiens; identical to SEQ ID NO: 1026473

SEQ ID NO: 1026477 - protein, 135 aa, Homo sapiens [sequence omitted]

SEQ ID NO: 1026478 - protein, 87 aa, Homo sapiens; identical to SEQ ID NO: 1026470

SEQ ID NO: 1026479 - protein, 138 aa, Homo sapiens; identical to SEQ ID NO: 1026473

SEQ ID NO: 1026480 - protein, 138 aa, Homo sapiens; identical to SEQ ID NO: 1026473

SEQ ID NO: 1026481 - protein, 135 aa, Homo sapiens [sequence omitted]

SEQ ID NO: 1026482 - protein, 156 aa, Homo sapiens
ERERERGEREEREREREREREREERRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLDFGSLSNLQVTQPTVGMNFKTPRGPV

SEQ ID NO: 1026483 - protein, 85 aa, Homo sapiens
RDVPVKHVYRVLQCQEEELTQLVSTMSDGWKFEQLISIGSSYNYGNEDQAEFLCVVSRELNNSTNGIVIEPSEKAKILQERGSRM

SEQ ID NO: 1026484 - protein, 85 aa, Homo sapiens; identical to SEQ ID NO: 1026483

SEQ ID NO: 1026485 - protein, 85 aa, Homo sapiens; identical to SEQ ID NO: 1026483

SEQ ID NO: 1026486 - protein, 85 aa, Homo sapiens; identical to SEQ ID NO: 1026483

SEQ ID NO: 1026487 - protein, 85 aa, Homo sapiens; identical to SEQ ID NO: 1026483

SEQ ID NO: 1026488 - protein, 85 aa, Homo sapiens; identical to SEQ ID NO: 1026483

SEQ ID NO: 1026489 - protein, 85 aa, Homo sapiens; identical to SEQ ID NO: 1026483

SEQ ID NO: 1026490 - protein, 85 aa, Homo sapiens; identical to SEQ ID NO: 1026483

SEQ ID NO: 1026491 - protein, 85 aa, Homo sapiens; identical to SEQ ID NO: 1026483

SEQ ID NO: 1026492 - protein, 85 aa, Homo sapiens; identical to SEQ ID NO: 1026483

SEQ ID NO: 1026493 - protein, 85 aa, Homo sapiens; identical to SEQ ID NO: 1026483

SEQ ID NO: 1026494 - protein, 85 aa, Homo sapiens; identical to SEQ ID NO: 1026483

SEQ ID NO: 1026495 - protein, 85 aa, Homo sapiens; identical to SEQ ID NO: 1026483

SEQ ID NO: 1026496 - protein, 110 aa, Homo sapiens
FPQVNVTGACYNEKLFLFDAGGSYTHTPPRRAVETKPRLRYTQNAEKINQALHEQDGDGKTKGAPCDRGAGSPGGSSHGAGLNRDHPCRASQGGEPYPGPSAPRHTCFSP

SEQ ID NO: 1026497 - protein, 127 aa, Homo sapiens
MLFSMTRGQSPGAAPGAQPEISKLAGYKKPKDREAACVKSATHGGRTQAACGHSAGPGLQGEAAGEGRGEGAFWLKARNSKYSSLGINIPPNKGAQGSCLGKVGCRRHDPRHSGLSAPFPRPMSQAL

SEQ ID NO: 1026498 - protein, 127 aa, Homo sapiens
MLFSMTRGQSPGAAPGAQPEISKLAGYKKQKEQGSCLRKKCHPRRQDTGSVWPFSRPGLQGEAAGEGRGEGAFWLKARNSKYSSLGINIPPNKGAQGSCLGKVGCRRHDPRHSGLSAPFPRPMSQAL

SEQ ID NO: 1026499 - protein, 127 aa, Homo sapiens; identical to SEQ ID NO: 1026498

SEQ ID NO: 1026500 - protein, 1348 aa, Homo sapiens
GAKDLVCSKMSRAKDAVSSGVASVVDVAKGVVQGGLDTTRSALTGTKEAVSSGVTGAMDMAKGAVQGGLDTSKAVLTGTKDTVSTGLTGAVNVAKGTVQAGVDTTKTVLTGTKDTVTTGVMGAVNLAKGTVQTGVETSKAVLTGTKDAVSTGLTGAVNVARGSIQTGVDTSKTVLTGTKDTVCSGVTSAMNVAKGTIQTGVDTSKTVLTGTKDTVCSGVTGAMNVAKGTIQTGVDTSKTVLTGTKDTVCSGVTGAMNVAKGTIQTGVDTTKTVLTGTKNTVCSGVTGAVNLAKEAIQGGLDTTKSMVMGTKDTMSTGLTGAANVAKGAMQTGLNTTQNIATGTKDTVCSGVTGAMNLARGTIQTGVDTTKIVLTGTKDTVCSGVTGAANVAKGAVQGGLDTTKSVLTGTKDAVSTGLTGAVNVAKGTVQTGVDTTKTVLTGTKDTVCSGVTSAVNVAKGAVQGGLDTTKSVVIGTKDTMSTGLTGAANVAKGAVQTGVDTAKTVLTGTKDTVTTGLVGAVNVAKGTVQTGMDTTKTVLTGTKDTIYSGVTSAVNVAKGAVQTGLKTTQNIATGTKNTFGSGVTGAVNVAKGAVQTGVDTAKTVLTGTKDTVTTGLMGAVNVAKGTVQTSVDTTKTVLTGTKDTVCSGVTGAANVAKGAVQTGVDTAKTVLTGTKDTVCSGVTGAVNVAKGAVQTGLKTTQNIATGTKNTLGSGVTGAANVAKGAVQGGLDTTKSVLTGTKDAVSTGLTGAVNLAKGTVQTGMDTTKTVLTGTKDAVCSGVTGAANVAKGAVQTGVDTAKTVLTGTKDTVTTGLMGAVNVAKGTVQTSVDTTKTVLTGTKDTVCSGVTGAANVAKGAVQGGLDTTKSVLTGTKDTVSTGLTGAVNLAKGTVQTGVDTSKTVLTGTKDTVCSGVTGAVNVAKGTVQTGVDTAKTVLSGAKDAVTTGVTGAVNVAKGTVQTGVDASKAVLMGTKDTVFSGVTGAMSMAKGAVQGGLDTTKTVLTGTKDAVSAGLMGSGNVATGATHTGLSTFQNWLPSTPATSWGGLTSSRTTDNGGEQTALSPQEAPFSGISTPPDVLSVGPEPAWEAAATTKGLATDVATFTQGAAPGREDTGLLTTTHGPEEAPRLAMLQNELEGLGDIFHPMNAEEQAQLAASQPGPKVLSAEQGSYFVRLGDLGPSFRQRAFEHAVSHLQHGQFQARDTLAQLQDCFRLIEKAQQAPEGQPRLDQGSGASAEDAAVQEERDAGVLSRVCGLLRQLHTAYSGLVSSLQGLPAELQQPVGRARHSLCELYGIVASAGSVEELPAERLVQSREGVHQAWQGLEQLLEGLQHNPPLSWLVGPFALPAGGQ

SEQ ID NO: 1026501 - protein, 1349 aa, Homo sapiens
GAKDLVCSKMSRAKDAVSSGVASVVDVAKGVVQGGLDTTRSALTGTKEAVSSGVTGAMDMAKGAVQGGLDTSKAVLTGTKDTVSTGLTGAVNVAKGDRTGLVWTTTKTVLTGTKDTVTTGVMGAVNLAKGTVQTGVETSKAVLTGTKDAVSTGLTGAVNVARGSIQTGVDTSKTVLTGTKDTVCSGVTSAMNVAKGTIQTGVDTSKTVLTGTKDTVCSGVTGAMNVAKGTIQTGVDTSKTVLTGTKDTVCSGVTGAMNVAKGTIQTGVDTTKTVLTGTKNTVCSGVTGAVNLAKEAIQGGLDTTKSMVMGTKDTMSTGLTGAANVAKGAMQTGLNTTQNIATGTKDTVCSGVTGAMNLARGTIQTGVDTTKIVLTGTKDTVCSGVTGAANVAKGAVQGGLDTTKSVLTGTKDAVSTGLTGAVNVAKGTVQTGVDTTKTVLTGTKDTVCSGVTSAVNVAKGAVQGGLDTTKSVVIGTKDTMSTGLTGAANVAKGAVQTGVDTAKTVLTGTKDTVTTGLVGAVNVAKGTVQTGMDTTKTVLTGTKDTIYSGVTSAVNVAKGAVQTGLKTTQNIATGTKNTFGSGVTGAVNVAKGAVQTGVDTAKTVLTGTKDTVTTGLMGAVNVAKGTVQTSVDTTKTVLTGTKDTVCSGVTGAANVAKGAVQTGVDTAKTVLTGTKDTVCSGVTGAVNVAKGAVQTGLKTTQNIATGTKNTLGSGVTGAANVAKGAVQGGLDTTKSVLTGTKDAVSTGLTGAVNLAKGTVQTGMDTTKTVLTGTKDAVCSGVTGAANVAKGAVQTGVDTAKTVLTGTKDTVTTGLMGAVNVAKGTVQTSVDTTKTVLTGTKDTVCSGVTGAANVAKGAVQGGLDTTKSVLTGTKDTVSTGLTGAVNLAKGTVQTGVDTSKTVLTGTKDTVCSGVTGAVNVAKGTVQTGVDTAKTVLSGAKDAVTTGVTGAVNVAKGTVQTGVDASKAVLMGTKDTVFSGVTGAMSMAKGAVQGGLDTTKTVLTGTKDAVSAGLMGSGNVATGATHTGLSTFQNWLPSTPATSWGGLTSSRTTDNGGEQTALSPQEAPFSGISTPPDVLSVGPEPAWEAAATTKGLATDVATFTQGAAPGREDTGLLTTTHGPEEAPRLAMLQNELEGLGDIFHPMNAEEQAQLAASQPGPKVLSAEQGSYFVRLGDLGPSFRQRAFEHAVSHLQHGQFQARDTLAQLQDCFRLIEKAQQAPEGQPRLDQGSGASAEDAAVQEERDAGVLSRVCGLLRQLHTAYSGLVSSLQGLPAELQQPVGRARHSLCELYGIVASAGSVEELPAERLVQSREGVHQAWQGLEQLLEGLQHNPPLSWLVGPFALPAGGQ

SEQ ID NO: 1026502 - protein, 952 aa, Homo sapiens
GAKDLVCSKMSRAKDAVSSGVASVVDVAKGVVQGGLDTTRSALTGTKEAVSSGVTGAMDMAKGAVQGGLDTSKAVLTGTKDTVSTGLTGAVNVAKGTVQAGVDTTKTVLTGTKDTVTTGVMGAVNLAKGTVQTGVETSKAVLTGTKDAVSTGLTGAVNVARGSIQTGVDTSKTVLTGTKDTVCSGVTSAMNVAKGTIQTGVDTSKTVLTGTKDTVCSGVTGAMNVAKGTIQTGVDTSKTVLTGTKDTVCSGVTGAMNVAKGTIQTGVDTTKTVLTGTKNTVCSGVTGAVNLAKEAIQGGLDTTKSMVMGTKDTMSTGLTGAANVAKGAMQTGLNTTQNIATGTKDTVCSGVTGAMNLARGTIQTGVDTTKIVLTGTKDTVCSGVTGAANVAKGAVQGGLDTTKSVLTGTKDAVSTGLTGAVNVAKGTVQTGVDTTKTVLTGTKDTVCSGVTSAVNVAKGAVQGGLDTTKSVVIGTKDTMSTGLTGAANVAKGAVQTGVDTAKTVLTGTKDTVTTGLVGAVNVAKGTVQTGMDTTKTVLTGTKDTIYSGVTSAVNVAKGAVQTGLKTTQNIATGTKNTFGSGVTGAVNVAKGAVQTGVDTAKTVLTGTKDTVTTGLMGAVNVAKGTVQTSVDTTKTVLTGTKDTVCSGVTGAANVAKGAVQTGVDTAKTVLTGTKDTVCSGVTGAVNVAKGAVQTGLKTTQNIATGTKNTLGSGVTGAANVAKGAVQGGLDTTKSVLTGTKDAVSTGLTGAVNLAKGTVQTGMDTTKTVLTGTKDAVCSGVTGAANVAKGAVQTGVDTAKTVLTGTKDTVTTGLMGAVNVAKGTVQTSVDTTKTVLTGTKDTVCSGVTGAANVAKGAVQGGLDTTKSVLTGTKDTVSTGLTGAVNLAKGTVQTGVDTSKTVLTGTKDTVCSGVTGAVNVAKGTVQTGVDTAKTVLSGAKDAVTTGVTGAVNVA

SEQ ID NO: 1026503 - protein, 375 aa, Homo sapiens
RGRGRGGARAGDQRAGAGSRSRVRAAAAMSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLGMPLSVSVRKGVGVDLGRARWPDRFSSTPIT

SEQ ID NO: 1026504 - protein, 530 aa, Homo sapiens
RGRGRGGARAGDQRAGAGSRSRVRAAAAMSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLLATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 1026505 - protein, 334 aa, Homo sapiens
GPRLARQAQGHLPRQDSRVDPSLEAEPPATNMDLRRGPWVGPWRRHTAAHRPRQTLDALLPPTSPKALDLLRRLLVFAPDKRLSATQALQHPYVQRFHCPSDEWAREADVRPRAHEGVQLSVPEYRSRVYQMILECGGSSGTSREKGPEGVSPSQAHLHKPRADPQLPSRTPVQGPRPRPQSSPGHDPAEHESPRAAKNVPRQNSAPLLQTALLGNGERPPGAKEAPPLTLSLVKPSGRGAAPSLTSQAAAQVANQALIRGDWNRGGGVRVASVQQVPPRLPPEARPGRRMFSTSALQGAQGGARALLGGYSQAYGTVCHSALGHLPLLEGHHV

SEQ ID NO: 1026506 - protein, 715 aa, Homo sapiens
MAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARNPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGLANHGQTRHMGPSRNLLLNGKSYPTKVRLIRGGSLPPVKRRRMNWIDAPGDVFYMPKEETRKIRKLLSSSETKRAARRPYKPIALRQSQALPPRPPPPAPVNDEPIVIED

SEQ ID NO: 1026507 - protein, 255 aa, Homo sapiens
MKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGTYLGLANHGQTRHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 1026508 - protein, 255 aa, Homo sapiens; identical to SEQ ID NO: 1026507

SEQ ID NO: 1026509 - protein, 255 aa, Homo sapiens; identical to SEQ ID NO: 1026507

SEQ ID NO: 1026510 - protein, 251 aa, Homo sapiens [sequence omitted]

SEQ ID NO: 1026511 - protein, 251 aa, Homo sapiens [sequence omitted]

SEQ ID NO: 1026512 - protein, 577 aa, Homo sapiens
AGTGRDFGIAPSAAPGSPGPSAAAGPDMAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPINSAAIKAECTARLPEASQSPLVLKQAVRKPLEAVLRYLETHPRPPQA

SEQ ID NO: 1026513 - protein, 251 aa, Homo sapiens [sequence omitted]

SEQ ID NO: 1026514 - protein, 577 aa, Homo sapiens; identical to SEQ ID NO: 1026512

SEQ ID NO: 1026515 - protein, 577 aa, Homo sapiens; identical to SEQ ID NO: 1026512

SEQ ID NO: 1026516 - protein, 790 aa, Homo sapiens
AGTGRDFGIAPSAAPGSPGPSAAAGPDMAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGSAPPPALTCRETRSLADTGGGEEEARLTYSENAEELSFLALCLLFGWSGDEGPPRAPVLRRGFHNYIGDLAHSIPCGQSCSYRGKHNRGSDGQHVRRRLLHAQLGSGKPRTDQAHGEEEQPMMGSGALTHELFGVLERRPGQPCQVPRGSFQEAWQDQRGCSMWGPWPLCQAQRCAADQPSGLPWARLGVRVAHWGGGGLARHSTLAGGPSQREPCRLRWSWPLAGCPGSAPPLQGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 1026517 - protein, 534 aa, Homo sapiens
AGTGRDFGIAPSAAPGSPGPSAAAGPDMAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPIVIED

SEQ ID NO: 1026518 - protein, 121 aa, Homo sapiens
MKKRLLMPSRGLANHGQTRHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 1026519 - protein, 517 aa, Homo sapiens
AGTGRDFGIAPSAAPGSPGPSAAAGPDMAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMQEDPQAALILGNQACCPPALQAHRPAPEPGPAAAATATCARQRRAHRHRGLGAAPTCGRPPPLARPHGPFPASPPPAPQFGSAPPPALTCRETRSLADTGGGEEEARLTYSENAEELSFLALCLLFGWSGDEGPPRAPVLRGLLPGGRALRFCCVLLKVPF

SEQ ID NO: 1026520 - protein, 529 aa, Homo sapiens
AGTGRDFGIAPSAAPGSPGPSAAAGPDMAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGSAPPPALTCRETRSLADTGGGEEEARLTYSENAEELSFLALCLLFGWSGDEGPPRAPVLPVPLCCGAFCPEAGP

SEQ ID NO: 1026521 - protein, 150 aa, Homo sapiens
AELIPLHSSLNRVRSVGTRAVGVQDALSRGLISLLHFSSGLANHGQTRHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 1026522 - protein, 403 aa, Homo sapiens
AGTGRDFGIAPSAAPGSPGPSAAAGPDMAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPWRTLGEERKKRG

SEQ ID NO: 1026523 - protein, 165 aa, Homo sapiens
SGHAPLACPCSFLPTSLGGVCVSPQPQPSFPGHPPSHLVLGLPPLPSPWASPLWAGFTCLFLMAGRPRNSPIRAGRNRRESLSAGIFELFVLFCKKRLTCRETRSLADTGGGEEEARLTYSENAEELSFLALCLLFGWSGDEGPPRAPVLPVPLCCGAFCPEAGP

SEQ ID NO: 1026524 - protein, 168 aa, Homo sapiens
SGHAPLACPCSFLPTSLGGVCVSPQPQPSFPGHPPSHLVLGLPPLPSPWASPLWAGFTCLFLMAGRPRNSPIRAGRNRRESLSAGIFELFVLFCKKRLTCRETRSKLHKSLFVPTEFSKCPTSRPHLQRNALLGGHWGRRGRSAANLFRECRGVVVFSFVFTFWLERR

SEQ ID NO: 1026525 - protein, 577 aa, Homo sapiens; identical to SEQ ID NO: 1026512

SEQ ID NO: 1026526 - protein, 577 aa, Homo sapiens; identical to SEQ ID NO: 1026512

SEQ ID NO: 1026527 - protein, 577 aa, Homo sapiens; identical to SEQ ID NO: 1026512

SEQ ID NO: 1026528 - protein, 184 aa, Homo sapiens [sequence omitted]

SEQ ID NO: 1026529 - protein, 457 aa, Homo sapiens
AGTGRDFGIAPSAAPGSPGPSAAAGPDMAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYMSSLRILLDILEEIWWLENANPVRWREARTKPQ

SEQ ID NO: 1026530 - protein, 445 aa, Homo sapiens
AGTGRDFGIAPSAAPGSPGPSAAAGPDMAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGPKVLLCSVEGAILNFIFITFFVDELELCNLHLEC

SEQ ID NO: 1026531 - protein, 211 aa, Homo sapiens
MDPASWPNSRSAPWAPHPALWEVRGLWHPIPKHMPGGWGPARAVGGDLFLAGAGGSLRALGKSPASWWGSAGHSVAALQRGLCRCWTDSLAEALLVSARQGLANHGQTRHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 1026532 - protein, 163 aa, Homo sapiens
LNFPHLTRESQPCSACEGASPLAAWLGGALGSEGSATEEAPVLTCSGQDLGAGEEASWVKTAPGGTGAHEVGSLSSLGRHELIRGGSLPPVKRRRMNWIDAPDDVFYMATEETRKIRKLLSSSETKRAARRPYKPIALRQSQALPPRPPPPAPVNDEPIVIED

SEQ ID NO: 1026533 - protein, 94 aa, Homo sapiens
ISVVSTSLWYNFWHSPASIISAPPPALTCRETRSLADTGGGEEEARLTYSENAEELSFLALCLLFGWSGDEGPPRAPVLPVPLCCGAFCPEAGP

SEQ ID NO: 1026534 - protein, 715 aa, Homo sapiens; identical to SEQ ID NO: 1026506

SEQ ID NO: 1026535 - protein, 255 aa, Homo sapiens; identical to SEQ ID NO: 1026507

SEQ ID NO: 1026536 - protein, 255 aa, Homo sapiens; identical to SEQ ID NO: 1026507

SEQ ID NO: 1026537 - protein, 255 aa, Homo sapiens; identical to SEQ ID NO: 1026507

SEQ ID NO: 1026538 - protein, 255 aa, Homo sapiens; identical to SEQ ID NO: 1026507

SEQ ID NO: 1026539 - protein, 453 aa, Homo sapiens
EEVKSTTKTQRIASHSHVQRAGAGRERLGQAGGSGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 1026540 - protein, 396 aa, Homo sapiens
MAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 1026541 - protein, 453 aa, Homo sapiens; identical to SEQ ID NO: 1026539

SEQ ID NO: 1026542 - protein, 426 aa, Homo sapiens
EEVKSTTKTQRIASHSHVQRAGAGRERLGQAGGSGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKILADQQDKYMK

SEQ ID NO: 1026543 - protein, 372 aa, Homo sapiens
EEVKSTTKTQRIASHSHVQRAGAGRERLGQAGGSGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQVP

SEQ ID NO: 1026544 - protein, 385 aa, Homo sapiens
EEVKSTTKTQRIASHSHVQRAGAGRERLGQAGGSGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQVPSRVLYVQHTTASQ

SEQ ID NO: 1026545 - protein, 453 aa, Homo sapiens; identical to SEQ ID NO: 1026539

SEQ ID NO: 1026546 - protein, 453 aa, Homo sapiens; identical to SEQ ID NO: 1026539

SEQ ID NO: 1026547 - protein, 412 aa, Homo sapiens
EEVKSTTKTQRIASHSHVQRAGAGRERLGQAGGSGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQQVCLAWVQPVGACPWAWGCRPHSGVVCSAVSSVWKAFLFKLS

SEQ ID NO: 1026548 - protein, 1377 aa, Homo sapiens
DSRCSVAASASSTNLIHLSSKGHISPAKDTSLQQRTPAEMSPVLHFYVRPSGHEGAASGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSFAHPPSAEVEAIALATLHDRMTEQHFPHPIQSFSPESMPEPLNGPINILGEGRLALEKANQELGLALDSWDLDFYTKRFQELQRNPSTVEAFDLAQSNSEHSRHWFFKGQLHVDGQKLVHSLFESIMSTQESSNPNNVLKFCDNSSAIQGKEVRFLRPEDPTRPSRFQQQQGLRHVVFTAETHNFPTGVCPFSGATTGTGGRIRDVQCTGRGAHVVAGTAGYCFGNLHIPGYNLPWEDLSFQYPGNFARPLEVAIEASNGASDYGNKFGEPVLAGFARSLGLQLPDGQRREWIKPIMFSGGIGSMEADHISKEAPEPGMEVVKVGGPVYRIGVGGGAASSVQVQGDNTSDLDFGAVQRGDPEMEQKMNRVIRACVEAPKGNPICSLHDQGAGGNGNVLKELSDPAGAIIYTSRFQLGDPTLNALEIWGAEYQESNALLLRSPNRDFLTHVSARERCPACFVGTITGDRRIVLVDDRECPVRRNGQGGCPPDTLPTPVDLELEWVLGKMPRKEFFLQRKPPMLQPLALPPGLSVHQALERVLRLPAVASKRYLTNKVDRSVGGLVAQQQCVGPLQTPLADVAVVALSHEELIGAATALGEQPVKSLLDPKVAARLAVAEALTNLVFALVTDLRDVKCSGNWMWAAKLPGEGAALADACEAMVAVMAALGVAVDGGKDSLSMAARVGTETVRAPGSLVISAYAVCPDITATVTPDLKHPEGRGHLLYVALSPGQHRLGGTALAQCFSQLGEHPPDLDLPENLVRAFSITQGLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGAELRRFRKRPDTFSLGVCNGCQLLALLGWVGGDPNEDAAEMGPDSQPARPGLLLRHNLSGRYESRWASVRVGPGPALMLRGMEGAVLPVWSAHGEGYVAFSSPELQAQIEARGLAPLHWADDDGNPTEQYPLNPNGSPGGVAGICSCDGRHLAVMPHPERAVRPWQWAWRPPPFDTLTTSPWLQLFINARNWTLEGSC

SEQ ID NO: 1026549 - protein, 1416 aa, Homo sapiens
DSRCSVAASASSTNLIHLSSKGHISPAKDTSLQQRTPAEMSPVLHFYVRPSGHEGAASGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSFAHPPSAEVEAIALATLHDRMTEQHFPHPIQSFSPESMPEPLNGPINILGEGRLALEKANQELGLALDSWDLDFYTKRFQELQRNPSTVEAFDLAQSNSEHSRHWFFKGQLHVDGQKLVHSLFESIMSTQESSNPNNVLKFCDNSRCCALDWVGVRTRGGEAPGPGWVSVGPQKGSKVHDGYVHSAIQGKEVRFLRPEDPTRPSRFQQQQGLRHVVFTAETHNFPTGVCPFSGATTGTGGRIRDVQCTGRGAHVVAGTAGYCFGNLHIPGYNLPWEDLSFQYPGNFARPLEVAIEASNGASDYGNKFGEPVLAGFARSLGLQLPDGQRREWIKPIMFSGGIGSMEADHISKEAPEPGMEVVKVGGPVYRIGVGGGAASSVQVQGDNTSDLDFGAVQRGDPEMEQKMNRVIRACVEAPKGNPICSLHDQGAGGNGNVLKELSDPAGAIIYTSRFQLGDPTLNALEIWGAEYQESNALLLRSPNRDFLTHVSARERCPACFVGTITGDRRIVLVDDRECPVRRNGQGDAPPTPLPTPVDLELEWVLGKMPRKEFFLQRKPPMLQPLALPPGLSVHQALERVLRLPAVASKRYLTNKVDRSVGGLVAQQQCVGPLQTPLADVAVVALSHEELIGAATALGEQPVKSLLDPKVAARLAVAEALTNLVFALVTDLRDVKCSGNWMWAAKLPGEGAALADACEAMVAVMAALGVAVDGGKDSLSMAARVGTETVRAPGSLVISAYAVCPDITATVTPDLKHPEGRGHLLYVALSPGQHRLGGTALAQCFSQLGEHPPDLDLPENLVRAFSITQGLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGAELRRFRKRPDTFSLGVCNGCQLLALLGWVGGDPNEDAAEMGPDSQPARPGLLLRHNLSGRYESRWASVRVGPGPALMLRGMEGAVLPVWSAHGEGYVAFSSPELQAQIEARGLAPLHWADDDGNPTEQYPLNPNGSPGGVAGICSCDGRHLAVMPHPERAVRPWQWAWRPPPFDTLTTSPWLQLFINARNWTLEGSC

SEQ ID NO: 1026550 - protein, 1416 aa, Homo sapiens; identical to SEQ ID NO: 1026549

SEQ ID NO: 1026551 - protein, 119 aa, Homo sapiens
ARGKDLGSHFPPPSIPGYVAFSSPELQAQIEARGLAPLHWADDDGNPTEQYPLNPNGSPGGVAGICSCDGRHLAVMPHPERAVRPWQWAWRPPPFDTLTTSPWLQLFINARNWTLEGSC

SEQ ID NO: 1026552 - protein, 1317 aa, Homo sapiens
DSRCSVAASASSTNLIHLSSKGHISPAKDTSLQQRTPAEMSPVLHFYVRPSGHEGAASGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSFAHPPSAEVEAIALATLHDRMTEQHFPHPIQSFSPESMPEPLNGPINILGEGRLALEKANQELGLALDSWDLDFYTKRFQELQRNPSTVEAFDLAQSNSEHSRHWFFKGQLHVDGQKLVHSLFESIMSTQESSNPNNVLKFCDNSRCCALDWVGVRTRGGEAPGPGWVSVGPQKGSKVHDGYVHSAIQGKEVRFLRPEDPTRPSRFQQQQGLRHVVFTAETHNFPTGVCPFSGATTGTGGRIRDVQCTGRGAHVVAGTAGYCFGNLHIPGYNLPWEDLSFQYPGNFARPLEVAIEASNGASDYGNKFGEPVLAGFARSLGLQLPDGQRREWIKPIMFSGGIGSMEADHISKEAPEPGMEVVKVGGPVYRIGVGGGAASSVQVQGDNTSDLDFGAVQRGDPEMEQKMNRVIRACVEAPKGNPICSLHDQGAGGNGNVLKELSDPAGAIIYTSRFQLGDPTLNALEIWGAEYQESNALLLRSPNRDFLTHVSARERCPACFVGTITGDRRIVLVDDRECPVRRNGQGDAPPTPLPTPVDLELEWVLGKMPRKEFFLQRKPPMLQPLALPPGLSVHQALERVLRLPAVASKRYLTNKVDRSVGGLVAQQQCVGPLQTPLADVAVVALSHEELIGAATALGEQPVKSLLDPKVAARLAVAEALTNLVFALVTDLRDVKCSGNWMWAAKLPGEGAALADACEAMVAVMAALGVAVDGGKDSLSMAARVGTETVRAPGSLVISAYAVCPDITATVTPDLKHPEGRGHLLYVALSPGQHRLGGTALAQCFSQLGEHPPDLDLPENLVRAFSITQGLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGVEYNGVISAHCNLCLLGSSNFPASASRVAGSTGTHHHTQLIFVFLVEIGFHHVSQAGLKLLTSSDSPASASQSAGITGGSHYSWPSSSVSDRGGWGSHP

SEQ ID NO: 1026553 - protein, 620 aa, Homo sapiens
DSRCSVAASASSTNLIHLSSKGHISPAKDTSLQQRTPAEMSPVLHFYVRPSGHEGAASGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSFAHPPSAEVEAIALATLHDRMTEQHFPHPIQSFSPESMPEPLNGPINILGEGRLALEKANQELGLALDSWDLDFYTKRFQELQRNPSTVEAFDLAQSNSEHSRHWFFKGQLHVDGQKLVHSLFESIMSTQESSNPNNVLKFCDNSRCCALDWVGVRTRGGEAPGPGWVSVGPQKGSKVHDGYVHSAIQGKEVRFLRPEDPTRPSRFQQQQGLRHVVFTAETHNFPTGVCPFSGATTGTGGRIRDVQCTGRGAHVVAGTAGYCFGNLHIPGYNLPWEDLSFQYPGNFARPLEVAIEASNGASDYGNKFGEPVLAGFARSLGLQLPDGQRREWIKPIMFSGGIGSMEADHISKEAPEPGMEVVKVGGPVYRIGVGGGAASSVQVQGDNTSDLDFGAVQRGDPEMEQKMNRVIRACVEAPKGNPICSLHDQGAGGNGEERSWNKRLGLPGILPGFV

SEQ ID NO: 1026554 - protein, 1416 aa, Homo sapiens; identical to SEQ ID NO: 1026549

SEQ ID NO: 1026555 - protein, 1416 aa, Homo sapiens; identical to SEQ ID NO: 1026549

SEQ ID NO: 1026556 - protein, 1416 aa, Homo sapiens; identical to SEQ ID NO: 1026549

SEQ ID NO: 1026557 - protein, 83 aa, Homo sapiens
MTCSVALLLILGLRCSGVRPGLVGEGHNPSLLVCLLLKDSRTNQGSCPGGPWSERDIESVTSDNCEATLGYRNHSLPSNYYNS

SEQ ID NO: 1026558 - protein, 83 aa, Homo sapiens; identical to SEQ ID NO: 1026557

SEQ ID NO: 1026559 - protein, 93 aa, Homo sapiens
WLQAMVKKETLNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 1026560 - protein, 83 aa, Homo sapiens; identical to SEQ ID NO: 1026557

SEQ ID NO: 1026561 - protein, 1444 aa, Homo sapiens [sequence omitted]

SEQ ID NO: 1026562 - protein, 1104 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKKQLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGNLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSK

SEQ ID NO: 1026563 - protein, 1791 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGNLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 1026564 - protein, 1791 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 1026565 - protein, 75 aa, Homo sapiens
GQAHDSHKSQQLRKPLFTRIPLLTPEVTNVFLLPWLWLYGGPFQSKSSKNVLSAYCVLRLGYSAAPTLRGPLAIV

SEQ ID NO: 1026566 - protein, 92 aa, Homo sapiens
QTQRRARAMASERLPNRPACLLVASGAAEGVSAQSFLHCFTMASTAFNLQVATPGGKAMEFVDVTESNARWVQDFRLKAYSSLANMMKPHLY

SEQ ID NO: 1026567 - protein, 71 aa, Homo sapiens
DLQDPIPALGMRKLVGRVVGVCSPSLLGGLGQENRLDPGGGGCSELTSCHCTLVWVTEQDSISKKKKKKIL

SEQ ID NO: 1026568 - protein, 220 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 1026569 - protein, 287 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRSSSLCPKADRHWQHFPVEEIFLACGFKVAGLGAAPGWGRGGKQEDRPPEEQRRAGEDFPIYQCVFIYP

SEQ ID NO: 1026570 - protein, 201 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSELGQRRKARGQTSRRAAEGG

SEQ ID NO: 1026571 - protein, 250 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSAAAASCPKADRHWQHFPVEEIFLACGFKVAGFGQAPGWGRGGKQEDRPPEEQRRAGEDFPIYQCVFIYP

SEQ ID NO: 1026572 - protein, 230 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGAWACLRSPHPAPQPSVCELVRAPGFARLPLVVEDFVKDSGACFSAAGAEEESKRTDLQKSSGGRVRISPYTSVCSSTHEE

SEQ ID NO: 1026573 - protein, 80 aa, Homo sapiens
FGTRKTVQLGRAQWLTPVTPALWEAEAGGSRGQEIETILANMVKPISTKKKKKKKKENIVNLVAYKQQKSVSVLEAGSPR

SEQ ID NO: 1026574 - protein, 220 aa, Homo sapiens; identical to SEQ ID NO: 1026568

SEQ ID NO: 1026575 - protein, 257 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSATQTGCPMLTLGAPPGVRGSQWVRWTLPEVWCPRSSPASEPDAVHVVLDRHLVTGQNASSTVPAVQNLLFLCGSRK

SEQ ID NO: 1026576 - protein, 233 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGAWACLRSPHPAPQPSVCELVRAPGFARLPLVVEDFVKDSGACFSASEPDAVHVVLDRHLVTGQNASSTVPAVQNLLFLCGSRK

SEQ ID NO: 1026577 - protein, 217 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSAAGAEEESKRTDLQKSSGGRVRISPYTSVCSSTHEE

SEQ ID NO: 1026578 - protein, 178 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAARGGGLREGFGRLLQCSWGRGGKQEDRPPEEQRRAGEDFPIYQCVFIYP

SEQ ID NO: 1026579 - protein, 562 aa, Homo sapiens
MAASAKRKQEEKHLKMLRDMTGLPRNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGRTPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 1026580 - protein, 562 aa, Homo sapiens; identical to SEQ ID NO: 1026579

SEQ ID NO: 1026581 - protein, 660 aa, Homo sapiens
WRRRRRLSRLCRLVWPVSPRTTAPGPRRAQYSQAAAAGSGAGGARRRRAAAAARAARGTAGPRRSAARLPALPASSLGAAAMAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFWSNAFSSVSSAHFAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 1026582 - protein, 571 aa, Homo sapiens
WRRRRRLSRLCRLVWPVSPRTTAPGPRRAQYSQAAAAGSGAGGARRRRAAAAARAARGTAGPRRSAARLPALPASSLGAAAMAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGAFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 1026583 - protein, 378 aa, Homo sapiens
WRRRRRLSRLCRLVWPVSPRTTAPGPRRAQYSQAAAAGSGAGGARRRRAAAAARAARGTAGPRRSAARLPALPASSLGAAAMAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAMFLEQCQWLLLHRHSLLHQVCLLHLELRLPQIHLLLLLVLLWHLLQTHFRPMPEEQQRQPLALHP

SEQ ID NO: 1026584 - protein, 353 aa, Homo sapiens
MCHVFSFIVFIFINICGSLPFTAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 1026585 - protein, 596 aa, Homo sapiens
WRRRRRLSRLCRLVWPVSPRTTAPGPRRAQYSQAAAAGSGAGGARRRRAAAAARAARGTAGPRRSAARLPALPASSLGAAAMAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGKI

SEQ ID NO: 1026586 - protein, 604 aa, Homo sapiens
WRRRRRLSRLCRLVWPVSPRTTAPGPRRAQYSQAAAAGSGAGGARRRRAAAAARAARGTAGPRRSAARLPALPASSLGAAAMAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 1026587 - protein, 440 aa, Homo sapiens
MEMKYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 1026588 - protein, 162 aa, Homo sapiens
PEAACRWLIVTPDPSNNMLILVSPDPFGSTPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 1026589 - protein, 426 aa, Homo sapiens
WRRRRRLSRLCRLVWPVSPRTTAPGPRRAQYSQAAAAGSGAGGARRRRAAAAARAARGTAGPRRSAARLPALPASSLGAAAMAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGIKL

SEQ ID NO: 1026590 - protein, 202 aa, Homo sapiens
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFESFFRRGGRSGKWFMLWFTHVIQGILWGSRLKQDPPVIHELRVSLEEIYSGCTKRMKISRKRLNADGRSYRSEDKILTIEIKKGWKEGTKITFP

SEQ ID NO: 1026591 - protein, 322 aa, Homo sapiens
HEWVLLTRAPERTICCHRRPAEGIADFGRWQCCMTPVIQDNPSGWGPCAVPEQFAGYASYQPFSEGRSLEEEVAALDEEPSIAKIRGTQSKYSSQIWWWKSKYAYFHEEDDSSFQLVAVRGARRRRATKGIEGEFAQQEIIRRDMDRRSMLQFNPAGILSYPVSRQGWRDEAHSDVLETVPETKFGVRQNWDQNSTERPVDSSVEVRGEWEVTEAWAWPQMVRWLLWTYVLLVACEGGGPTLSPVLCTGRSEVWICRGRCKGFSCVYTPGNCLRHWGTRDVCLMHLQVDVPQVRMGQVPPCRRLLSQGTYPRFSLWSDRGDT

SEQ ID NO: 1026592 - protein, 118 aa, Homo sapiens
IPKNTQAQFFLIAQVVKSGQNGPHSSMVSFLPVSCPSNRGYRASTSAHVMLPWARSGTMLGSSEISALICRIESRSPQSCSVGGLVHCVKVNGDTKSHANLISPGIAPFRLTRKSSTL

SEQ ID NO: 1026593 - protein, 103 aa, Homo sapiens
QVSIYDALTIDIIFQCIGHLDGNQQSFDQEVPTSLDVAWLLFWSKVKGSSPDASSVCRIRCFTCSHSTNIDSRWYSSAMPKVLFRDSSMADSRALSFSFFRKP

SEQ ID NO: 1026594 - protein, 254 aa, Homo sapiens
MAATARRGWGAAAVAAGLRRRFCHMLKNPYTIKKQPLHQFVQRPLFPLPAAFYHPVRYMFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 1026595 - protein, 231 aa, Homo sapiens [sequence omitted]

SEQ ID NO: 1026596 - protein, 221 aa, Homo sapiens
MAATARRGWGAAAVAAGLRRRFCHMLKNPYTIKKQPLHQFVQRPLFPLPAAFYHPVRYMFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPSGEAGSEEDDEVVAMIKELLDTRIRYVLLSLPEFKCFGGIFHYSNIVLVGHEIIVDFQNKCKLM

SEQ ID NO: 1026597 - protein, 185 aa, Homo sapiens
MAATARRGWGAAAVAAGLRRRFCHMLKNPYTIKKQPLHQFVQRPLFPLPAAFYHPVRYMFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPSGEAGSEEDDEVVAMIKELLDTRIRGYG

SEQ ID NO: 1026598 - protein, 113 aa, Homo sapiens
MDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 1026599 - protein, 196 aa, Homo sapiens
MFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 1026600 - protein, 857 aa, Homo sapiens
GTRPGWDGSCTTSTISFSFVSFPGTQQRRPPGLRPPHHPRGQDQLWLVLTGLTQQVALTFLRLLDVHTEVEEEEEKEEGSSLAQEQVAQGLRRLEGSSWPFSMVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVELEAARRVEKEALARLREQAARVGTQVEEAAEGVLRALLAQKQEVLGQLRAHVEAAEEAARERLAELEGREQVARAAAAFARRVLSLGREAEILSLEGAIAQRLRQLQGCPWAPGPAPCLLPQLELHPGLLDKNCHLLRLSFEEQQPQKDGGKDGAGTQGGEESQSRREDEPKTERQGGVQPQAGDGAQTPKEEKAQTTREEGAQTLEEDRAQTPHEDGGPQPHRGGRPNKKKKFKGRLKSISREPSPALGPNLDGSGLLPRPIFYCSFPTRMPGDKRSPRITGLCPFGPREILVADEQNRALKRFSLNGDYKGTVPVPEGCSPCSVAALQSAVAFSASARLYLINPNGEVQWRRALSLSQASHAVAALPSGDRVAVSVAGHVEVYNMEGSLATRFIPGGKASRGLRALVFLTTSPQGHFVGSDWQQNSVVICDGLGQVVGEYKGPGLHGCQPGSVSVDKKGYIFLTLREVNKVVILDPKGSLLGDFLTAYHGLEKPRVTTMVDGRYLVVSLSNGTIHIFRVRSPDS

SEQ ID NO: 1026601 - protein, 398 aa, Homo sapiens
GTRPGWDGSCTTSTISFSFVSFPGTQQRRPPGLRPPHHPRGQDQLWLVLTGLTQQVALTFLRLLDVHTEVEEEEEKEEGSSLAQEQVAQGLRRLEGSSWPFSMVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVELEAARRVEKEALARLREQAARVGTQVEEAAEGVLRALLAQKQENHLNPGGGSCSELRSHHCTPAWVT

SEQ ID NO: 1026602 - protein, 839 aa, Homo sapiens
GTRPGWDGSCTTSTISFSFVSFPGTQQRRPPGLRPPHHPRGQDQLWLVLTGLTQQVALTFLRLLDVHTEVEEEEEKEEGSSLAQEQVAQGLRRLEGSSWPFSMVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVELEAARRVEKEALARLREQAARVGTQVEEAAEGVLRALLAQKQEVLGQLRAHVEAAEEAARERLAELEGREQVARAAAAFARRVLSLGREAEILSLEGAIAQRLRQLQGCPWAPGPAPCLLPQLELHPGLLDKNCHLLRLSFEEQQPQKDGGKDGAGTQGGEESQSRREDEPKTERQGGVQPQAGDGAQTPKEEKAQTTREEGAQTLEEDRAQTPHEDGGPQPHRGGRPNKKKKFKGRLKSISREPSPALGPNLDGSGLLPRPIFYCSFPTRMPGDKRSPRITGLCPFGPREILVADEQNRALKRFSLNGDYKGTVPVPEGCSPCSVAALQSAVAFSASARLYLINPNGEVQWRRALSLSQASHAVAALPSGDRVAVSVAGHVEVYNMEGSLATRFIPGGKASRGLRALVFLTTSPQGHFVGSDWQQNSVVICDGLGQVVGEYKGPGLHGCQPGSVSVDKKGYIFLTLREVNKVVILDPKGSLLGDFLTAYHGLGNGTIHIFRVRSPDS

SEQ ID NO: 1026603 - protein, 254 aa, Homo sapiens
GTRPGWDGSCTTSTISFSFVSFPGTQQRRPPGLRPPHHPRGQDQLWLVLTGLTQQVALTFLRLLDVHTEVEEEEEKEEGSSLAQEQVAQGLRRLEGSSWPFSMVSHGSSPSLLEALSSDFLACKICLEQLRAPKTLPCLHTYCQGSSDVLVVVVSMLSTAPRAHPATFVFQVSMSTKVYKGDSCKPLLRAQELHSILTPIVPPTQAITLGPCLPTHQGDRFASSYKLTITMGDQTYNEMGDVDQFPPPETWGSL

SEQ ID NO: 1026604 - protein, 594 aa, Homo sapiens
GTRPGWDGSCTTSTISFSFVSFPGTQQRRPPGLRPPHHPRGQDQLWLVLTGLTQQVALTFLRLLDVHTEVEEEEEKEEGSSLAQEQVAQGLRRLEGSSWPFSMVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVELEAARRVEKEALARLREQAARVGTQVEEAAEGVLRALLAQKQEVLGQLRAHVEAAEEAARERLAELEGREQVARAAAAFARRVLSLGREAEILSLEGAIAQRLRQLQGCPWAPGPAPCLLPQLELHPGLLDKNCHLLRLSFEEQQPQKDGGKDGAGTQGGEESQSRREDEPKTERQGGVQPQAGDGAQTPKEEKAQTTREEGAQTLEEDRAQTPHEDGGPQPHRGGRPNKKKKFKGRLKSISCASPAHSCCADECLLDPHLDS

SEQ ID NO: 1026605 - protein, 72 aa, Homo sapiens
PGNAEARVGGSFPLQFMSWLPLEFCTGEVGWDVQNKQDFLLEQVWTSELEMGTETTISCAPCGQGRTHWSLI

SEQ ID NO: 1026606 - protein, 68 aa, Homo sapiens
AQPPAVLCGSQLQPLRCSKTREEAKTELSQPGIAALALKVTKKTRKTRKVIREAGELVKVTDPRFSAP

SEQ ID NO: 1026607 - protein, 75 aa, Homo sapiens
HVVHDIRESRQDMPRAVTTHYGDDTHGFPPPRVQALSWTSAGNVDTPSSVCGGQRMCLHPQTFRSCAESVPQPVS

SEQ ID NO: 1026608 - protein, 127 aa, Homo sapiens
GSTPRCALRFAAAAASVLQDQRGSKDRAFPARHRCFGLEGDKEDKEDKEGDPGGWRACQGHRPTVFRPLGSKLFPGHLQAMSTRPPVSVAGKGCVSTPRPSDPVLKVSLSLFPEKPRGFWLVTFSFS

SEQ ID NO: 1026609 - protein, 72 aa, Homo sapiens; identical to SEQ ID NO: 1026605

SEQ ID NO: 1026610 - protein, 72 aa, Homo sapiens; identical to SEQ ID NO: 1026605

SEQ ID NO: 1026611 - protein, 127 aa, Homo sapiens; identical to SEQ ID NO: 1026608

SEQ ID NO: 1026612 - protein, 613 aa, Homo sapiens
MDTNFWVLLRDGIKTSKILEMTNIDGKSQFVSYEMQRNLSLEHAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGIRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 1026613 - protein, 811 aa, Homo sapiens
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGIRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 1026614 - protein, 671 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPAGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 1026615 - protein, 426 aa, Homo sapiens
MVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPAGTVHPLSAPYPPLDTPETATGSFLFQGEPEGGEGDQPLSGYPWFHGMLSRLKAAQLALTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 1026616 - protein, 683 aa, Homo sapiens [sequence omitted]

SEQ ID NO: 1026617 - protein, 301 aa, Homo sapiens
MTLPLAPGAGTGSRAGPMTLPLAPGTSFLTRENTDSLELSCLNHSESLPSQDLLLGPSESNDRLSQGAYGGLSDRPSASISPSSASIAASHFDSMELLPPELPPRIPIEEGPPAGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 1026618 - protein, 765 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPAGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGLFSYHSYPEPTTSHDPPQPPEPPSWTDPPQPGAEEASRAPEVAAAAAAAAKERQEKEKAGGGGVPEELVPVVELVPVVELEEAIAPGSEAQGAGSGGDAGVPPMVQLQQSPLGGDGEEGGHPRAINNQYSFV

SEQ ID NO: 1026619 - protein, 203 aa, Homo sapiens
ESERGREGREKKGKKKKRKVPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 1026620 - protein, 671 aa, Homo sapiens; identical to SEQ ID NO: 1026614

SEQ ID NO: 1026621 - protein, 121 aa, Homo sapiens
MAEVSMKVPFPPAAVLYGLFLQRRERGSCTPARNRAGRSSRSGWGRREREPPPPPPPPELTSGTEMQLLPPTPRLLAASLFVPHRLPRAGDLGSMSSLRGSSGQPHPGGHFPINYPQPEAG

SEQ ID NO: 1026622 - protein, 708 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGEKPDFCRYRDIEWGWGAALRLSPGDFPPSTIFPGLCRPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPAGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 1026623 - protein, 774 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPAGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGEQSRSAGEEVPVHPRSEEPTTSHDPPQPPEPPSWTDPPQPGAEEASRAPEVAAAAAAAAKERQEKEKAGGGGVPEELVPVVELVPVVELEEAIAPGSEAQGAGSGGDAGVPPMVQLQQSPLGGDGEEGGHPRAINNQYSFV

SEQ ID NO: 1026624 - protein, 120 aa, Homo sapiens
MTTRDKKRTRVKYVLTFNFQGKAKHLRLSLNEEGQCRVQHLWFQSIFDMLEHFRVHPIPLESGGSSDVVLVSYVPSSQRQQGREQAGSHAGVCEGDGCHPDASCTLMPFGASDCVTDHLP

SEQ ID NO: 1026625 - protein, 670 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPAGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQGEQSRSAGEEVPVHPRSEVCVPERWGGEGGLSTGEACV

SEQ ID NO: 1026626 - protein, 426 aa, Homo sapiens; identical to SEQ ID NO: 1026615

SEQ ID NO: 1026627 - protein, 426 aa, Homo sapiens; identical to SEQ ID NO: 1026615

SEQ ID NO: 1026628 - protein, 756 aa, Homo sapiens
MNGAPSPEDGASPSSPPLPPPPPPSWREFCESHARAAALDFARRFRLYLASHPQYAGPGAEAAFSRRFAELFLQHFEAEVARASGSLSPPILAPLSPGAEISPHDLSLESCRVGGPLAVLGPSRSSEDLAGPLPSSVSSSSTTSSKPKLKKRFSLRSVGRSVRGSVRGILQWRGTVDPPSSAGPLETSSGPPVLGGNSNSNSSGGAGTVGRGLVSDGTSPGERWTHRFERLRLSRGGGALKDGAGMVQREELLSFMGAEEAAPDPAGVGRGGGVAGPPSGGGGQPQWQKCRLLLRSEGEGGGGSRLEFFVPPKASRPRLSIPCSSITDVRTTTALEMPDRENTFVVKVEGPSEYIMETVDAQHVKAWVSDIQECLSPGPCPATSPRPMTLPLAPGTSFLTRENTDSLELSCLNHSESLPSQDLLLGPSESNDRLSQGAYGGLSDRPSASISPSSASIAASHFDSMELLPPELPPRIPIEEGPPAGTVHPLSAPYPPLDTPETATGSFLFQGEPEGGEGDQPLSGYPWFHGMLSRLKAAQLVLTGGTGSHGVFLVRQSETRRGEYVLTFNFQGKAKHLRLSLNEEGQCRVQHLWFQSIFDMLEHFRVHPIPLESGGSSDVVLVSYVPSSQRQQEPTTSHDPPQPPEPPSWTDPPQPGAEEASRAPEVAAAAAAAAKERQEKEKAGGGGVPEELVPVVELVPVVELEEAIAPGSEAQGAGSGGDAGVPPMVQLQQSPLGGDGEEGGHPRAINNQYSFV

SEQ ID NO: 1026629 - protein, 106 aa, Homo sapiens [sequence omitted]

SEQ ID NO: 1026630 - protein, 106 aa, Homo sapiens [sequence omitted]

SEQ ID NO: 1026631 - protein, 212 aa, Homo sapiens
MVNVPKTRRTFCKKCGKHQPHKVTQYKKGKDSLYAQGKRRYDRKQSGYGGQTKPIFRKKAKTTKKIVLRLECVEPNCRSKRMLAIKRCKHFELGGDKKKKKNTKTSAFLSSSRREEGHAQPAFGNAQARQAMAVEGGMNLCEVLGSTSFLRGLWPLCQGDLIAVGVGAQFVLSQTIIPGATPGSLLPVVIIAGGVFLFREGYEGQLRACTEN

SEQ ID NO: 1026632 - protein, 106 aa, Homo sapiens [sequence omitted]

SEQ ID NO: 1026633 - protein, 106 aa, Homo sapiens [sequence omitted]

SEQ ID NO: 1026634 - protein, 106 aa, Homo sapiens [sequence omitted]

SEQ ID NO: 1026635 - protein, 149 aa, Homo sapiens
ASPLRDEEEEEEEMVVSEEEEEKGPSDPVLSVIFYYEDNKILSLCSKKKKKKKKKKKKKFKKKKKRKKQKQQKGAWARAPRGAPTRKKVFPETTTSWWAARGGPTSRGAMETHRGRQNTSGVPQERGDLLGGDDENEGGGGGLLPPQIT

SEQ ID NO: 1026636 - protein, 106 aa, Homo sapiens [sequence omitted]

SEQ ID NO: 1026637 - protein, 526 aa, Homo sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 1026638 - protein, 358 aa, Homo sapiens
MLANAATSILGIRDLVKLRYSCGYHKQGGFDRPWLEKASSASEDPKVCRSTQHSPRRPRCRAAEARPGGTSWRAAARRGDVRAEAHAGVKLAQNPAVTGNIRRAENAGESCFGFRLRWACVRLAKTMASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWVVHDGKS

SEQ ID NO: 1026639 - protein, 358 aa, Homo sapiens; identical to SEQ ID NO: 1026638

SEQ ID NO: 1026640 - protein, 358 aa, Homo sapiens; identical to SEQ ID NO: 1026638

SEQ ID NO: 1026641 - protein, 358 aa, Homo sapiens; identical to SEQ ID NO: 1026638

SEQ ID NO: 1026642 - protein, 701 aa, Homo sapiens
MLANAATSILGIRDLVKLRYSCGYHKQGGFDRPWLEKASSASEDPKVCRSTQHSPRRPRCRAAEARPGGTSWRAAARRGDVRAEAHAGVKLAQNPAVTGNIRRAENAGESCFGFRLRWACVRLAKTMASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKSTSYIYQSLGDVEWYIEMKLSSWQHELKYRKSPRRSQCSENRSLESGTNRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 1026643 - protein, 358 aa, Homo sapiens; identical to SEQ ID NO: 1026638

SEQ ID NO: 1026644 - protein, 172 aa, Homo sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKSDQLHLPKPG

SEQ ID NO: 1026645 - protein, 227 aa, Homo sapiens
ILCLLYILVTWCVSCSGMKALDMNSCRGLSSLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 1026646 - protein, 141 aa, Homo sapiens
SNICMNLFTYHDESLVHRKAYEKSFSLSPPGSSSSTHPERLTDYAKKARVVPGPQQLLQYCQLCAEHTRDDLKSSNRHGHKRKKSRSRSQSKSRDHSDAAKKHRHERGHHRDRRERSRSFERSHKSKHHGGSRSGHGRHRR

SEQ ID NO: 1026647 - protein, 554 aa, Homo sapiens
MLANAATSILGIRDLVKLRYSCGYHKQGGFDRPWLEKASSASEDPKVCRSTQHSPRRPRCRAAEARPGGTSWRAAARRGDVRAEAHAGVKLAQNPAVTGNIRRAENAGESCFGFRLRWACVRLAKTMASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRQDEVLLRCPGRSRTPGLK

SEQ ID NO: 1026648 - protein, 358 aa, Homo sapiens; identical to SEQ ID NO: 1026638

SEQ ID NO: 1026649 - protein, 298 aa, Homo sapiens
MLANAATSILGIRDLVKLRYSCGYHKQGGFDRPWLEKASSASEDPKVCRSTQHSPRRPRCRAAEARPGGTSWRAAARRGDVRAEAHAGVKLAQNPAVTGNIRRAENAGESCFGFRLRWACVRLAKTMASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKSDQLHLPKPG

SEQ ID NO: 1026650 - protein, 358 aa, Homo sapiens; identical to SEQ ID NO: 1026638

SEQ ID NO: 1026651 - protein, 358 aa, Homo sapiens; identical to SEQ ID NO: 1026638

SEQ ID NO: 1026652 - protein, 320 aa, Homo sapiens
MYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 1026653 - protein, 358 aa, Homo sapiens; identical to SEQ ID NO: 1026638

SEQ ID NO: 1026654 - protein, 358 aa, Homo sapiens; identical to SEQ ID NO: 1026638

SEQ ID NO: 1026655 - protein, 320 aa, Homo sapiens [sequence omitted]

SEQ ID NO: 1026656 - protein, 526 aa, Homo sapiens; identical to SEQ ID NO: 1026637

SEQ ID NO: 1026657 - protein, 298 aa, Homo sapiens; identical to SEQ ID NO: 1026649

SEQ ID NO: 1026658 - protein, 301 aa, Homo sapiens
MADQPKPISPLKNLLAGGFGGVCLVFVGHPLDTVKVRLQTQPPSLPGQPPMYSGTFDCFRKTLFREGITGLYRGMAAPIIGVTPMFAVCFFGFGLGKKLQQKHPEDVLSYPQLFAAGMLSGVFTTGIMTPGERIKCLLQIQASSGESKYTGTLDCAKKLYQEFGIRGIYKGTVLTLMRDVPASGMYFMTYEWLKNIFTPEGKRVSELSAPRILVAGGIAGIFNWAVAIPPDVLKSRFQTAPPGKYPNGFRDVLRELIRDEGVTSLYKGFNAVMIRAFPANAACFLGFEVAMKFLNWATPNL

SEQ ID NO: 1026659 - protein, 181 aa, Homo sapiens
MADQPKPISPLKNLLAGGFGGVCLVFVGHPLDTVKVRLQTQPPSLPGQPPMYSGTFDCFRKTLFREGITGLYRGMAAPIIGVTPMFAVCFFGFGLGKKLQQKHPEDVLSYPQLFAAGMLSGVFTTGIMTPGERIKCLLQIQASSGESKYTGTLDCAKKLYQEFGIRGIYKGTVLTLMRDDK

SEQ ID NO: 1026660 - protein, 301 aa, Homo sapiens; identical to SEQ ID NO: 1026658

SEQ ID NO: 1026661 - protein, 301 aa, Homo sapiens; identical to SEQ ID NO: 1026658

SEQ ID NO: 1026662 - protein, 408 aa, Homo sapiens
MLQNPQEKSQAYPRRRRPGCYAYRQNPEAIAAAAMYTFLPDNFSPAKPKPSKELKPLLAAVVAWCYYSVSLRKAERLRAELLDLKAGGFSIRNQKGEQVFRLAFRSGALDLDSCSRDGALLGCSLTADGLPLHFFIQTVRPKDTVMCYRVRWEEAAPGRAVEHAMFLGDAAAHWYGGAEMRTQHWPIRLDGQQEPQPFVTSDVYSSDAAFGGILERYWLSSRAAAIKVNDSVPFHLGWNSTERSLRLQARYHDTPYKPPAGRAAAPELSYRVCVGSDVTSIHKYMVRRYFNKPSRVPAPEAFRDPIWSTWALYGRAVDQDKVLRFAQQIRLHHFNSSHLEIDDMYTPAYGDFDFDEVKFPNASDMFRRLRDAGFRVTLWVHPFVNYNSSRFGEGVERELFVREPTGRL

SEQ ID NO: 1026663 - protein, 374 aa, Homo sapiens
MLQNPQEKSQAYPRRRRPGCYAYRQNPEAIAAAAMYTFLPDNFSPAKPKPSKELKPLLGSAVLGLLLVLAAVVAWCYYSVSLRKAERLRAELLDLKAGGFSIRNQKGEQVFRLAFRSGALDLDSCSRDGALLGCSLTAHWYGGAEMRTQHWPIRLDGQQEPQPFVTSDVYSSDAAFGGILERYWLSSRAAAIKVNDSVPFHLGWNSTERSLRLQARYHDTPYKPPAGRAAAPELSYRVCVGSDVTSIHKYMVRRYFNKPSRVPAPEAFRDPIWSTWALYGRAVDQDKVLRFAQQIRLHHFNSSHLEIDDMYTPAYGDFDFDEVKFPNASDMFRRLRDAGFRVTLWVHPFVNYNSSRFGEGVERELFVREPTGRL

SEQ ID NO: 1026664 - protein, 419 aa, Homo sapiens
MLQNPQEKSQAYPRRRRPGCYAYRQNPEAIAAAAMYTFLPDNFSPAKPKPSKELKPLLGSAVLGLLLVLAAVVAWCYYSVSLRKAERLRAELLDLKAGGFSIRNQKGEQVFRLAFRSGALDLDSCSRDGALLGCSLTADGLPLHFFIQTVRPKDTVMCYRVRWEEAAPGRAVEHAMFLGDAAAHWYGGAEMRTQHWPIRLDGQQEPQPFVTSDVYSSDAAFGGILERYWLSSRAAAIKVNDSVPFHLGWNSTERSLRLQARYHDTPYKPPAGRAAAPELSYRVCVGSDVTSIHKYMVRRYFNKPSRVPAPEAFRDPIWSTWALYGRAVDQDKVLRFAQQIRLHHFNSSHLEIDDMYTPAYGDFDFDEVKFPNASDMFRRLRDAGFRVTLWVHPFVNYNSSRFGEGVERELFVREPTGRL

SEQ ID NO: 1026665 - protein, 367 aa, Homo sapiens
MYAGLSLFTAGERGGRCLSVPRPRSLPVLGHLHIFAACRKIIHYTLRIITSQCYSFVTENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKAVNSIISIVFGTRRIAWAHLDRKLTVLDWQQSDRWSLMRGIYSSSVYLEEISSIISKMPKADFYVLEKTGLSIQNSSLFPILLHFHIMEAMLYALLNKTFAQDGQHQVLSMNRNAVGKHFELMIGDSRTSGKELVKQFLFDSILKADPRVFFPSDKIVHYRQMFLSTELQRVEELYDSLLQAIAFYELAVFDSQP

SEQ ID NO: 1026666 - protein, 249 aa, Homo sapiens
RGYVRKNWTLLDSSLEMYAGLSLFTAGERGGRCLSVPRPRSLPVLGHLHIFAACRKIIHYTLRIITSQCYSFVTENAKEPENALDKLFSSEQQASILHVLNTASTKELEAFRLLRGRRSINIVEHRENFGPFQNLESLMNVPLFKYKSTVQVCNSILCPKTGREKRKSPENRFLRKLLKPDIERERLKAVNSIISIVFGTRRIAWAHLDRKLTVLDWQQSDRWSLMRGIYSSSVYLEEVRQLHLQIPTC

SEQ ID NO: 1026667 - protein, 367 aa, Homo sapiens; identical to SEQ ID NO: 1026665

SEQ ID NO: 1026668 - protein, 367 aa, Homo sapiens; identical to SEQ ID NO: 1026665

SEQ ID NO: 1026669 - protein, 367 aa, Homo sapiens; identical to SEQ ID NO: 1026665

SEQ ID NO: 1026670 - protein, 67 aa, Homo sapiens
QLAQGREEHYEEEEEEEEDGAAVAEKSHRRAEMYRHPISRQRSANGFFSSCSNINLPTELWIFNYKN

SEQ ID NO: 1026671 - protein, 381 aa, Homo sapiens
SALEKKGPCDRDYKKFWAGLQGLTIYFYNSNRDFQHVEKLNLGAFEKLTDEIPWGSSRDPGTHFSLILRNQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPEPKVFNGGLGRKLPVSSAQPLLPHSRAGRHDGRATEEAGEKRRALEH

SEQ ID NO: 1026672 - protein, 358 aa, Homo sapiens
SALEKKGPCDRDYKKFWAGLQGLTIYFYNSNRDFQHVEKLNLGAFEKLTDEIPWGSSRDPGTHFSLILRNQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPHSRAGRHDGRATEEAGEKRRALEH

SEQ ID NO: 1026673 - protein, 178 aa, Homo sapiens
RPAQTQTYTWAHTQTHRDTCLSPGMHTDPPANLQVSLYDMGLDSDHVSPSGPAPCTGGPKPLSPASSQDKLPPLPPLPNQEENYVTPIGDGPAVDYENQDVASSSWPVILKPKKLPKPPAKLPKPPVGPKPEPKVFNGGLGRKLPVSSAQPLLPHSRAGRHDGRATEEAGEKRRALEH

SEQ ID NO: 1026674 - protein, 459 aa, Homo sapiens
SALEKKGPCDRDYKKFWAGLQGLTIYFYNSNRDFQHVEKLNLGAFEKLTDEIPWGSSRDPGTHFSLILRNQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPSRDGVSPCCQAGLELLSSSDATHFSLPKCWDYRREPPNLASICRLLQSPKSLMVAWAGSCQSVQPSLFFPTAGLADMTAELQKKLERRGGHWSTDSDTPGTSGLVPGHGQRPDSFSQDKNSDPRE

SEQ ID NO: 1026675 - protein, 416 aa, Homo sapiens
MASALSATPMAQAVWVSCLHTTMRALLGYEWGAMLTAYYRVSSRAGSASGHLPSVVVYDIMLLMRTILCYCGMKLNLGAFEKLTDEIPWGSSRDPGTHFSLILRNQEIKFKVETLECREMWKGFILTVVELRVPTDLTLLPGHLYMMSEVLAKEEARRALETPSCFLKVSRLEAQLLLERYPECGNLLLRPSGDGADGVSVTTRQMHNGTHVVRHYKVKREGPKYVIDVEQPFSCTSLDAVVNYFVSHTKKALVPFLLDEDYEKVLGYVEADKENGENVWVAPSAPGPGPAPCTGGPKPLSPASSQDKLPPLPPLPNQEENYVTPIGDGPAVDYENQDVASSSWPVILKPKKLPKPPAKLPKPPVGPKPEPKVFNGGLGRKLPVSSAQPLLPHSRAGRHDGRATEEAGEKRRALEH

SEQ ID NO: 1026676 - protein, 360 aa, Homo sapiens; identical to SEQ ID NO: 753172

SEQ ID NO: 1026677 - protein, 353 aa, Homo sapiens
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRKLLRKVDVERSPGGTPLTNKENMETGTGLTPVMTQALRRKFQLAHPRSPILLPQPPE

SEQ ID NO: 1026678 - protein, 132 aa, Homo sapiens
MSLPFSRRPLLERGEMPSEAVPSLPFHLLPPSFPRTDRSPGRSPLGYVPNLAPAVGMWMDVCIRERENMCCRPRAHTHDKCEGVAVAPCSDLGQFDSALGVCLYSYSCHCNDFTPNCDIFIKCVNKYIKIGK

SEQ ID NO: 1026679 - protein, 363 aa, Homo sapiens
PVSFFDDNLCEPSHISGPILLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRKEKKKGQNLLEKKCE

SEQ ID NO: 1026680 - protein, 370 aa, Homo sapiens
EPPAEEKEDLLKNFGAQSVRVLSDKGRLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRKEKKKGQNLLEKKCE

SEQ ID NO: 1026681 - protein, 200 aa, Homo sapiens
VLDSMKRDKNLNGAAAIRRQLARFLLPDEDEELSSEESEYESTDDEDRQRMNKLMELANLQPKRPKTIKQRHVRKKRKIKDMLNTPLCPSHSSLHPVLLPSDVFDQPQPVGNKRIEFHISTDMPAAFKKDLEKEQNCEEKNHDLPATEVDASNIGFGKIFPKPNLDITEEIKEDSDEMPSECISRKEKKKGQNLLEKKCE

SEQ ID NO: 1026682 - protein, 180 aa, Homo sapiens; identical to SEQ ID NO: 831501

SEQ ID NO: 1026683 - protein, 363 aa, Homo sapiens
MLPQNLSGYIWYKRQITYLYHYITSYVLNGQKIIYRPTYNKKKKIYSNSSLLIQNFTQEDAGSYTLHIVKRGDGTGGVTGHFTFTLYLETPKPSISSSNLNPREAMEAVSLTCDPETPDASYLWWMNGQSLPMTHRLQLSKTNRTLFLFGVTKYIAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGENLYLSCFADSNPPAQYSWTINGKFQLSGQKLFIPQITTKHSGLYACSVRNSATGKESSKSITVKVSDWILP

SEQ ID NO: 1026684 - protein, 209 aa, Homo sapiens
MMPYKPSLHEPSGDSSRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGENLYLSCFADSNPPAQYSWTINGKFQLSGQKLFIPQITTKHSGLYACSVRNSATGKESSKSITVKVSDWILP

SEQ ID NO: 1026685 - protein, 363 aa, Homo sapiens
MLPQNLSGYIWYKRQITYLYHYITSYVLNGQKIIYRPTYNKKKKIYSNSSLLIQNFTQEDAGSYTLHIVKRGDGTGGVTGHFTFTLYLETPKPSISSSNLNPREAMEAVSLTCDPETPDASYLWWMNGQSLPMTHRLQLSKTNRTLFLFGVTKYIAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGENLYLSCFADSNPPAQYSWTINGKFQLSGQKLFIPQITTKHSGLYACSVRNSATGKESSKSMTVEVSDWTVP

SEQ ID NO: 1026686 - protein, 363 aa, Homo sapiens; identical to SEQ ID NO: 1026685

SEQ ID NO: 1026687 - protein, 244 aa, Homo sapiens
MFTQEDAGSYTLHIVKRGDGTGGVTGHFTFTLYLETPKPSISSSNLNPREAMEAVSLTCDPETPDASYLWWMNGQSLPMTHRLQLSKTNRTLFLFGVTKYIAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLPKLPKPYITINNLNPREIKDREQEK

SEQ ID NO: 1026688 - protein, 363 aa, Homo sapiens; identical to SEQ ID NO: 1026685

SEQ ID NO: 1026689 - protein, 363 aa, Homo sapiens; identical to SEQ ID NO: 1026685

SEQ ID NO: 1026690 - protein, 363 aa, Homo sapiens; identical to SEQ ID NO: 1026683

SEQ ID NO: 1026691 - protein, 363 aa, Homo sapiens; identical to SEQ ID NO: 1026685

SEQ ID NO: 1026692 - protein, 363 aa, Homo sapiens; identical to SEQ ID NO: 1026685

SEQ ID NO: 1026693 - protein, 320 aa, Homo sapiens
MFTQEDAGSYTLHIVKRGDGTGGVTGHFTFTLYLETPKPSISSSNLNPREAMEAVSLTCDPETPDASYLWWMNGQSLPMTHRLQLSKTNRTLFLFGVTKYIAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGENLYLSCFADSNPPAQYSWTINGKFQLSGQKLFIPQITTKHSGLYACSVRNSATGKESSKSMTGQSLCCHSGKKDIFLALIHY

SEQ ID NO: 1026694 - protein, 328 aa, Homo sapiens
MGMNKVEEKKYIKKKNDDIECKKKDEGKYKLKIIKRGDETREEIRHFTFTLYLETPKPYISSSNLNPREAMEAVSLTCDPETPDASYLWWMNGQSLPMTHRLQLSKTNRTLFLFGVTKYIAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGENLYLSCFADSNPPAQYSWTINGKFQLSGQKLFIPQITTKHSGLYACSVRNSATGKESSKSITVKVSDWILP

SEQ ID NO: 1026695 - protein, 186 aa, Homo sapiens
RGSPDDYGGSSDHLATKCEVYKDVLNFTCEPKSENYTYIWWLNGQSLPVSPRVKRPIENRILILPSVTRNETGPYQCEIRDRYGGIRSDPVTLNVLYGPDLPRIYPSFTYYRSGENLYLSCFADSNPPAQYSWTINGKFQLSGQKLFIPQITTKHSGLYACSVRNSATGKESSKSITVKVSDWILP

SEQ ID NO: 1026696 - protein, 363 aa, Homo sapiens; identical to SEQ ID NO: 1026685

SEQ ID NO: 1026697 - protein, 299 aa, Homo sapiens
MMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 1026698 - protein, 143 aa, Homo sapiens
SGGCRGRPRGRGFEPGVCRPRRGCVGCGGCGRWRRPGPGSCPAAEAGATGAGVAAPEAMMGKEEEIARIARRLDKMVTKKSAHLSPATVWSLRLDPLFFWSFRASPASSQPLSSSFTGQPDTCLACGPIFFPVCPHPTRTRFL

SEQ ID NO: 1026699 - protein, 272 aa, Homo sapiens
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 1026700 - protein, 272 aa, Homo sapiens; identical to SEQ ID NO: 1026699

SEQ ID NO: 1026701 - protein, 272 aa, Homo sapiens; identical to SEQ ID NO: 1026699

SEQ ID NO: 1026702 - protein, 272 aa, Homo sapiens; identical to SEQ ID NO: 1026699

SEQ ID NO: 1026703 - protein, 299 aa, Homo sapiens; identical to SEQ ID NO: 1026697

SEQ ID NO: 1026704 - protein, 503 aa, Homo sapiens
SGGCRVRPRGRGFEPGVCRPRRGCVGCGGCGRWRRPGPGSCPAAEAGATGAGVAAPEAMMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEEYILWVGAVGLGFWWSQEAAWPGALWWLLDATAQLSRGHLPGWSPAWVVRLSHLRRAPGPAEGLILSACGAQVPWGCSLKLGLSQEWAWGRLGLQPFTSPPGVGGQTDPCVAGQNLSSPHPNMAPSGAGGMVEGSDVVLRWVLKTLARIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 1026705 - protein, 384 aa, Homo sapiens
SGGCRVRPRGRGFEPGVCRPRRGCVGCGGCGRWRRPGPGSCPAAEAGATGAGVAAPEAMMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEVSPCWRGWRAAPSERWAKPLSRRQEMAKMASDELKEIRKAMTKEAIREHQMARTGGTQTDLFTCGKCRKKNCTYTQVQTRSSDEPMTTFVVCNECGNRWKFC

SEQ ID NO: 1026706 - protein, 445 aa, Homo sapiens
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEEYILWVGAVGLGFWWSQEAAWPGALWWLLDATAQLSRGHLPGWSPAWVVRLSHLRRAPGPAEGLILSACGAYVPWGCSLKLGLSQEWAWGRLGLQPFTSPPGVGGQTDPCVAGQNLSSPHPNMAPSGAGGSVEGSDVVLRWVLKTLARIFRDVGNTDMKYKNRVRSRISNLKDAKNPDLRRNVLCGAITPQQIAVMTSEVSPCWRGWRAAPSERWAKPLSRRQEMAKMASDELKEIRKAMTKEAIREHQMARTGGTQTDLFTCGKCRKKNCTYTQVQTRSSDEPMTTFVVCNECGNRWKFC

SEQ ID NO: 1026707 - protein, 100 aa, Homo sapiens
SGGCRGRPRGRGFEPGVCRPRRGCVGCGGCGRWRRPGPGSCPAAEAGATGAGVAAPEAMMGKEEEIARIARRLDKMVTKKSARLSPSVSHSICRRQQFGV

SEQ ID NO: 1026708 - protein, 272 aa, Homo sapiens; identical to SEQ ID NO: 1026699

SEQ ID NO: 1026709 - protein, 272 aa, Homo sapiens; identical to SEQ ID NO: 1026699

SEQ ID NO: 1026710 - protein, 418 aa, Homo sapiens
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEEYILWVGAVGLGFWWSQEAAWPGALWWLLDATAQLSRGHLPGWSPAWVVRLSHLRRAPGPAEGLILSACGAYVPWGCSLKLGLSQEWAWGRLGLQPFTSPPGVGGQTDPCVAGQNLSSPHPNMAPSGAGGSVEGSDVVLRWVLKTLARIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 1026711 - protein, 382 aa, Homo sapiens
SGGCRVRPRGRGFEPGVCRPRRGCVGCGGCGRWRRPGPGSCPAAEAGATGAGVAAPEAMMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKVGEQAQAAPPSSILWRWGVSASVGSVV

SEQ ID NO: 1026712 - protein, 124 aa, Homo sapiens
SGGCRGRPRGRGFEPGVCRPRRGCVGCGGCGRWRRPGPGSCPAAEAGATGAGVAAPEAMMGKEEEIARIARRLDKMVTKKSAVRGAGRQDPGNPAPPRPRRARRPPLGPEDDLRGRTRPLPGRD

SEQ ID NO: 1026713 - protein, 299 aa, Homo sapiens; identical to SEQ ID NO: 1026697

SEQ ID NO: 1026714 - protein, 163 aa, Homo sapiens
LQLKPREAKCRMSKFQAVGTACASSEVATGWHMERRAEGLVQQEGGRRENRSLEGEGGDGPQCLLAGRDADSAQGQTKYPTQYTGSSCWCWFFIFSDTESHSVAQAGVQWPDLGSLQPPPPGFKRFSCLSLLSSWDYRRAPPCPANFFIFSRDGFLPCWLGWS

SEQ ID NO: 1026715 - protein, 163 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLN

SEQ ID NO: 1026716 - protein, 163 aa, Homo sapiens; identical to SEQ ID NO: 1026715

SEQ ID NO: 1026717 - protein, 215 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRTGERKRKSVRGCIVDANLSVLNLVIVKKGEKDIPGLTDTTVPRRLGPKRASRIRKLFNLSKEDDVRQYVVRKPLN

SEQ ID NO: 1026718 - protein, 125 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKISSWLHCGCKSERSQLGYCKKRREGYSWTD

SEQ ID NO: 1026719 - protein, 177 aa, Homo sapiens
MKLNISFPATGCQKLIEVDDERKLRTFYEKRMATEVAADALGEEWKGYVVRISGGNDKQGFPMKQGVLTHGRVPYSEQADTPWSRHNCLLLSKGHSCYRPRRTGERKRKSVRGCIVDANLSVLNLVIVKKGEKDIPGLTDTTVPRRLGPKRASRIRKLFNLSKEDDVRQYVVRKPLN

SEQ ID NO: 1026720 - protein, 125 aa, Homo sapiens; identical to SEQ ID NO: 1026718

SEQ ID NO: 1026721 - protein, 86 aa, Homo sapiens
PACPLLLGKGPPGDWRRKSVRGCIVDANLSVLNLVIVKKGEKDIPGLTDTTVPRRLGPKRASRIRKLFNLSKEDDVRQYVVRKPLN

SEQ ID NO: 1026722 - protein, 163 aa, Homo sapiens; identical to SEQ ID NO: 1026715

SEQ ID NO: 1026723 - protein, 163 aa, Homo sapiens; identical to SEQ ID NO: 1026715

SEQ ID NO: 1026724 - protein, 215 aa, Homo sapiens; identical to SEQ ID NO: 1026717

SEQ ID NO: 1026725 - protein, 125 aa, Homo sapiens; identical to SEQ ID NO: 1026718

SEQ ID NO: 1026726 - protein, 427 aa, Homo sapiens
MKLNISFPATGCQKLIEVDDERKLRTFYEKRMATEVAADALGEEWKGYVVRISGGNDKQGFPMKQGVLTHGRVQPCSLQSRGHSLFTSTQGSNWQQQHKQQHIQLQSVAIAGMQNICSDSSNMCVHWSNNKAAARHHIHGTCTCITSPDSQSTSLGAPEDSSVSQHIQQQHCSNHHHHKTSMQSSGADIVGQSNKPVQHNSTGKATPYGTKRPAQQISHSESRDSHTKRWSLPDTKRTAIEAHDSKQQSPKNNITETDGLARLTGLKPEAHTTTRTGTAYRADTPPVQHKGDSRPHEHLTSFGGRCTTFDTTSNARHRQDVRNNTEVAQTHRVKEHSNSAHRDRHRGTRPNQKETNTTTEGGHQNDAAPEPTTNCIVTTQGGPQQNRIGKYESNKKQGTERLINRGVPVAKQLDTATMGPQHTIRST

SEQ ID NO: 1026727 - protein, 283 aa, Homo sapiens
GLFLTIQVLCSALIPLQLQSPWVLASLVGPGSPRPARLPHPALRTPGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 1026728 - protein, 510 aa, Homo sapiens
GLFLTIQVLCSALIPLQLQSPWVLASLVGPGSPRPARLPHPALRTPGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKGLALTQAGGSDTVAAHCSLDLLGSSNPPASASRVAESTDLHNGSSKQAKATQTTGQICLSPRIWPGSASATSTVCSSSESFLPRGPPAVSLLLHGPPTVSFPPPWATHHVLPSPVAHPPCPCLPPDMPLELPGPCCCPHCLCDSAPPSLPCPTLVQGASRPILILRAFPGPCHSVPCHDLKLQVGASPFRHGCPPSVRCPSRLIAGVPGCSVLSWSLGHSLSGIDSRMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 1026729 - protein, 768 aa, Homo sapiens
GLFLTIQVLCSALIPLQLQSPWVLASLVGPGSPRPARLPHPALRTPGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKGLALTQAGGSDTVAAHCSLDLLGSSNPPASASRVAESTDLHNGSSKQAKATQTTGQICLSPRIWPGSASATSTVCSSSESFLPRGPPAVSLLLHGPPTVSFPPPWATHHVLPSPVAHPPCPCLPPDMPLELPGPCCCPHCLCDSAPPSLPCPTLVQGASRPILILRAFPGPCHSVPCHDLKLQVGASPFRHGCPPSVRCPSRLIAGVPGCSVLSWSLGHSLSGIDSRMLWALRERITEALSRDGYVYKYDLSLPVERLYDIVTDLRARLGPHAKHVVGYGHLGERRPGAAALCVLVVGPTVTVTLPGFEAGQFDHGLWLSISPVDTGRTTVSDREGKILIVVMTRFEYFGKDCHRALVMAERMAQLVRTFWDLQWHAGLEGISLNPGVRDAGLRGSSHRARPRGLCSAEPPAALPLQMGGFQNHVQIIFFLQKNHALTCKLLIHRKKMFQSYQFFFSRRSFTLVTQAGVQWRNLGFTELHLLGFTQFSLPSLPSLWDCRRQHQGWLILDLGETGFEAMGRDGLELLNVGCTGQSGPSQGGTYRRWSPLGRQDNGNRLCEPVKQRLKGPKSTRRDNNDEWQRAHAAKKIRRHRRGQQTHNTPAARMRHRGERAEQHLAKRALRILLQ

SEQ ID NO: 1026730 - protein, 151 aa, Homo sapiens
GDWASCSEWAGIPRKWDKSASSEVAPALYASAATPRHGARVTGLEVLLCHPVQVSAPSLCACETFSLENSSLISTCLCIASLSRPERWARAPSCCSVSGAARLQTPPLSSFPSLHLRVGFPRAAASLVAPTNPGALTYLFEEQRLLSAGKT

SEQ ID NO: 1026731 - protein, 591 aa, Homo sapiens
GLFLTIQVLCSALIPLQLQSPWVLASLVGPGSPRPARLPHPALRTPGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKGLALTQAGGSDTVAAHCSLDLLGSSNPPASASRVAESTDLHNGSSKQAKATQTTGQICLSPRIWPGSASATSTVCSSSESFLPRGPPAVSLLLHGPPTVSFPPPWATHHVLPSPVAHPPCPCLPPDMPLELPGPCCCPHCLCDSAPPSLPCPTLVQGASRPILILRAFPGPCHSVPCHDLKLQVGASPFRHGCPPSVRCPSRLIAGVPGCSVLSWSLGHSLSGIDSRWIGATPGLGHSLSWVRAPPGLGHSLSGVGATPGLGHLLSGVGASPGEDTEHAAALTPCGVPPVPGCRSHSQPLSHLVSSSEMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 1026732 - protein, 323 aa, Homo sapiens
MPLELPGPCCCPHCLCDSAPPSLPCPTLVQGASRPILILRAFPGPCHSVPCHDLKLQVGASPFRHGCPPSVRCPSRLIAGVPGCSVLSWSLGHSLSGIDSRWIGATPGLGHSLSWVRAPPGLGHSLSGVGATPGLGHLLSGVGASPGEDTEHAAALTPCGVPPVPGCRSHSQPLSHLVSSSEMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 1026733 - protein, 151 aa, Homo sapiens
SLPDHQVLCSALIPLQLQSPCVLASLVGPGSPRPARLPHPALRTPGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKGLALTQAGVQ

SEQ ID NO: 1026734 - protein, 267 aa, Homo sapiens
IFTYRRGFALPGQAGLKLLTSGYPPASAPQSAGITVTMPLRPAQRPLQCLAPSCSTPSDGRISNHVQIIFFLQKNHALTCKLLIHRKKMFQSYQFFFSRRSFTLVTQAGVQWRNLGFTELHLLGFTQFSLPSLPSLWDCRRQHQGWLILDLGETGFEAMGRDGLELLNVGCTGQSGPSQGGTYRRWSPLGRQDNGNRLCEPVKQRLKGPKSTRRDNNDEGNGPMRPKRSGDTDGGSRHTTHQRQECATEERERTASSKTGAPHIAAV

SEQ ID NO: 1026735 - protein, 338 aa, Homo sapiens
PELLSPGFPECSSGQKQSAQIPEEITNGGTISVLREVSPVTNQQKALAHVVYIQPIKLLIFMNAVISVSASFFLDKMATPAVPVSAPPATPTPVPAAAPASVPAPTPAPAAAPVPAAAPASSSDPAAAAAATAAPGQTPASAQAPAQTPAPALPGPALPGPFPGGRVVRLHPVILASIVDSYERRNEGAARVIGTLLGTVDKHSVEVTNCFSVPHNESEDEVAVDMEFAKNMYELHTKVSPNELILGWYATGHDITEHSVLIHEYYSREAPKPIHLTVDTSLQNGRMSIKAYVSTLMGVPGRTMGVMFTPLTVKYAYYDTERIGVDLIMKTCFSPQQR

SEQ ID NO: 1026736 - protein, 378 aa, Homo sapiens
PELLSPGFPECSSGQKQSAQIPEEITNGGTISVLREVSPVTNQQKALAHVVYIQPIKLLIFMNAVISFRLLLSRQDGHTGGTSKCSSGHANPSPGGGPSLSSSANASTGCGSGSRCGSSLILRPCGSSGCNCGSWPDPGLSASSSADPSARSAWSCSSRALPRRPRGQAAPSHFGLHCGQLRETQRGCCPSYRDPVGNCRQTLKWRSPIAFQCRTMSQKMKCVGIQAVPLQFLAVHLLGSPHGPSHTHELELLEPRSFFPFVAVDMEFAKNMYELHTKVSPNELILGWYATGHDITEHSVLIHEYYSREAPKPIHLTVDTSLQNGRMSIKAYVSTLMGVPGRTMGVMFTPLTVKYAYYDTERIGVDLIMKTCFSPQQR

SEQ ID NO: 1026737 - protein, 334 aa, Homo sapiens
PELLSPGFPECSSGQKQSAQIPEEITNGGTISVLREVSPVTNQQKALAHVVYIQPIKLLIFMNAVISFRLLLSRQDGHTGGTSKCSSGHANPSPGGGPSLSSSANASTGCGSGSRCGSSLILRPCGSSGCNCGSWPDPGLSASSSADPSARSAWSCSSRALPRRPRGQAAPSHFGLHCGQLRETQRGCCPSYRDPVGNCRQTLKWRSPIAFQCRTMSQKMKWLLTWNLLRICMNCIQKFLQMSSSWAGKLGRWGLGLMEGLFVIAGVFCYWTGSYTLPFGGKSIASVLLTVSSGSMPVIPAGRLRQEDHLSPVVQDQPEQNSETLSLQKHFLKT

SEQ ID NO: 1026738 - protein, 338 aa, Homo sapiens; identical to SEQ ID NO: 1026735

SEQ ID NO: 1026739 - protein, 132 aa, Homo sapiens
MCRQVCARATRLVGHPRVSLFYFRGALLHARNLLCDPTEGVGDFHVGPRSFTARLHTVTALPRERRGNPVFREEERKSEETQNIEDQGKGPAASGVNSCKSPHFGRAEGTEESMRSGKFETKPGPNSGQRCV

SEQ ID NO: 1026740 - protein, 293 aa, Homo sapiens
MLSSLLLVAVASGYGPPSSRPSSRVVNGEDAVPYSWPWQVSLQYEKSGSFYHTCGGSLIAPDWVVTAGQCISSSWTYQVVLGEYNLGVKEGPEQVIPINIWGPSVCIHSGTASCVACGNDIALIKLSRSCPAGRCQSSFASLPPGGDIAFAKRDIPCYITGWGRLVYQAGQVPDKLQEALLPRWWDYEQLLQVDTWWGTSGEDNHWCVLERDIRIRAANVVTHGRDPPRTWPHSMDWLADTGPLVVKPSIWNTDLLGMHTKARRKGPREFHYEVIRAPSTWNSRKTIRKAHWN

SEQ ID NO: 1026741 - protein, 314 aa, Homo sapiens
MRSCYVAQAGLKLVRSSDPPASASQSTRITASGYGPPSSRPSSRVVNGEDAVPYSWPWQVSLQYEKSGSFYHTCGGSLIAPDWVVTAGQCISSSWTYQVVLGRVQPWCEGGPRRQVIPINIWGPSVCIHSGTASCVACGNDIALIKLSRSCPAGRCQSSFASLPPGGDIAFAKRDIPCYITGWGRLVYQAGQVPDKLQEALLPRWWDYEQLLQVDTWWGTSGEDNHWCVLERDIRIRAANVVTHGRDPPRTWPHSMDWLADTGPLVVKPSIWNTDLLGMHTKARRKGPREFHYEVIRAPSTWNSRKTIRKAHWN

SEQ ID NO: 1026742 - protein, 209 aa, Homo sapiens
CGRRIPMERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDGESEQYPKPTASEVEAGQDHIHYRTAGDHMADSCAKYTQRHS

SEQ ID NO: 1026743 - protein, 738 aa, Homo sapiens
CGRRIPMERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVPPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 1026744 - protein, 730 aa, Homo sapiens
CGRRIPMERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVPPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 1026745 - protein, 738 aa, Homo sapiens; identical to SEQ ID NO: 1026743

SEQ ID NO: 1026746 - protein, 543 aa, Homo sapiens
MLSGQANDSVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVPPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 1026747 - protein, 242 aa, Homo sapiens
MLSGQANDSVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERLEKEEQDRM

SEQ ID NO: 1026748 - protein, 397 aa, Homo sapiens
MPRAPLPCACGAACPGCGSCRDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERQSGIFAKEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRRPRGGAGGGGGEGGGGGGKRTLLIKTVETRDGQVINETSQHHDDLE

SEQ ID NO: 1026749 - protein, 207 aa, Homo sapiens
MPRAPLPCACGAACPGCGSCRDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERQSGIFAEENPFWNLHAEESRTSSSDQDTCPIDVMFQLTQAASYVV

SEQ ID NO: 1026750 - protein, 493 aa, Homo sapiens
TRGLSLRGPRARDAAALPPPTPTAPSFASSPGASPREGGGGSAVEGGEVELGGGGRRGGGEGEGGGGEGGGGGGGGGGGGREGEGERVGGGGGGVGGVWGGGGGGAGGEGGEEGLGVGGGRGEVGRGGEEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERQVESLPEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 1026751 - protein, 407 aa, Homo sapiens
MPRAPLPCACGAACPGCGSCRDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERQSGIFAKEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 1026752 - protein, 407 aa, Homo sapiens; identical to SEQ ID NO: 1026751

SEQ ID NO: 1026753 - protein, 407 aa, Homo sapiens; identical to SEQ ID NO: 1026751

SEQ ID NO: 1026754 - protein, 174 aa, Homo sapiens
MPRAPLPCACGAACPGCGSCRDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERQSGIFAKKRLPF

SEQ ID NO: 1026755 - protein, 137 aa, Homo sapiens
MATITITNTILASLEPLSSFCGANGGGCVGSLWGLPLGSSAWLRLGVLWEPVAKGLWSQCRGGPGFSTVESIDDYVNVPESGESAEASLDGSREYVNVSQELHPGAAKTEPAALSSQEAEEVEEEGAPDYENLQELN

SEQ ID NO: 1026756 - protein, 233 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 1026757 - protein, 233 aa, Homo sapiens; identical to SEQ ID NO: 1026756

SEQ ID NO: 1026758 - protein, 233 aa, Homo sapiens; identical to SEQ ID NO: 1026756

SEQ ID NO: 1026759 - protein, 286 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPVAAQPLPLQSSAPPPPNSTLYPTFLDWGPLSLLQLLLPPEPHLRHDPWPLTPRRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 1026760 - protein, 245 aa, Homo sapiens
AGGREGGHGEAGAEEGQVGLGRRGNWIPRLQPRPWSDHPGSRDFPQSAGRTLSPVKEGTHPGSPGEGTAASSRAPLPPGAYLPPAPCRVRSSPHLHLALTLPLRGLGVQPACSPSQDPRSPLGAPQPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 1026761 - protein, 165 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAELRACGGRVCPGTRLAWDG

SEQ ID NO: 1026762 - protein, 187 aa, Homo sapiens [sequence omitted]

SEQ ID NO: 1026763 - protein, 351 aa, Homo sapiens
MEEAILVPCVLGLLLLPILAMLMALCVHCHRLPGEWETGGGTQGPGTPTGSSSTPSPCVCPGSVPASVLIPAPLRVPGSQHLLPYAPPVPSSPALSFPGSYDSTSSDSLYPRGIQFKRPHTVAPWPPAYPPVTSYPPLSQPDLLPIPVAAQPLPLQSSAPPPPNSTLYPTFLDWGPLSLLQLLLPPEPHLRHDPWPLTPRRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 1026764 - protein, 66 aa, Homo sapiens
GSPGAEGPRIDMILKVIVMVQGAGADRGSSASGRGAVRKHHQVAWVVIVVLILIRILTWRPALAPA

SEQ ID NO: 1026765 - protein, 262 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 1026766 - protein, 233 aa, Homo sapiens; identical to SEQ ID NO: 1026756

SEQ ID NO: 1026767 - protein, 221 aa, Homo sapiens
MRENNLAAESHSPPLYPPPRGGTQHLSGDDTFPLTLGRRPTHGGATREGVGFFSPREGHSLGAKVGPLYIHSRGDSGDLSRVRSTHSRGFPSIREETHHPTRNFGHVCPHLHTPTISRYITPQCVKNSPPNTLYLNAYTSTKRKKAAGKAHEHPRKGEESFLNTTEKKRRNNEEITEQRKIDQKAVDSQILPKIKAIPQLQGYLRSVFALTNGIYPHKLVF

SEQ ID NO: 1026768 - protein, 177 aa, Homo sapiens
MPRYYPTEDVPRKLLSHGKKPFSQHVRKLRASITPGTILIILTGRHRGKRVVFLKQLASGLLLVTGPLVLNRVPLRRTHQKFVIATSTKIDISNVKIPKHLTDAYFKKKKLRKPRHQEGEIFDTEKEKYEITEQRKIDQKAVDSQILPKIKAIPQLQGYLRSVFALTNGIYPHKLVF

SEQ ID NO: 1026769 - protein, 177 aa, Homo sapiens; identical to SEQ ID NO: 1026768

SEQ ID NO: 1026770 - protein, 173 aa, Homo sapiens
MPRYYPTEDVPRKLLSHGKKPFSQHVRKLRASITPGTILIILTGRHRGKRVVFLKQLASGLLLVTGPLVLNRVPLRRTHQKFVIATSTKIDISNVKIPQEKKENPINILLMLTSRRRSCGSPDTRKVRSSTQKKRNMRLRSSARLIRKLWTHKFYQKSKLFLSSRATCDLCLL

SEQ ID NO: 1026771 - protein, 105 aa, Homo sapiens
FSFPSCKMAGEKVEKPDTKEKKPEAKKVDAGGKVKKGNLKAKKPKKGKPHCSRNPVLVRGIGRYSRSAMYSRKAMYKRKYSAAKSKVEKNKEGEGSRNCYKTSWW

SEQ ID NO: 1026772 - protein, 334 aa, Homo sapiens
FSFPSCKMAGEKVEKPDTKEKKPEAKKVDAGGKVKKGNLKAKKPKKGKPHCSRNPVLVRGIGRYSRSAPPKFGLFPYKKKEDKGPSLGFTRGSTQPLNPRLKRTKKEKVLATVTKPVGGDKNGGTGFKTPPPGGGLWRVVKLRKMPRYYPTEDVPRKLLSHGKKPFSQHVRKLRASITPGTILIILTGRHRGKRVVFLKQLASGLLLVTWGTPSLGGFPPFHGPLVLNRVPLRRTHQKFVIATSTKIDISNVKIPKHLTDAYFKKKKLRKPRHQEGEIFDTEKEKYEITEQRKIDQKAVDSQILPKIKAIPQLQGYLRSVFALTNGIYPHKLVF

SEQ ID NO: 1026773 - protein, 177 aa, Homo sapiens; identical to SEQ ID NO: 1026768

SEQ ID NO: 1026774 - protein, 100 aa, Homo sapiens
NTKNMTMKLHWKYEISNSKVQKHLTDAYFKKKKLRKPRHQEGEIFDTEKEKYEITEQRKIDQKAVDSQILPKIKAIPQLQGYLRSVFALTNGIYPHKLVF

SEQ ID NO: 1026775 - protein, 177 aa, Homo sapiens; identical to SEQ ID NO: 1026768

SEQ ID NO: 1026776 - protein, 105 aa, Homo sapiens; identical to SEQ ID NO: 1026771

SEQ ID NO: 1026777 - protein, 337 aa, Homo sapiens
FSFPSCKMAGEKVEKPDTKEKKPEAKKVDAGGKVKKGNLKAKKPKKGKPHCSRNPVLVRGIGRYSRSAMYSRKAMSLSRTRSHSRSNPTGRIRARKHRHEGVSTTPELTNRPDIALRWIIGNRERSTPCVALRDLSSDTIALKIYMPTGKDVALWTMLYDANVRIENALSARASGEEELCRMLEQLNPSVEPEFVNPSLHCERSTGWQGGVVFLKQLASGLLLVTGPLVLNRVPLRRTHQKFVIATSTKIDISNVKIPKHLTDAYFKKKKLRKPRHQEGEIFDTEKEKYEITEQRKIDQKAVDSQILPKIKAIPQLQGYLRSVFALTNGIYPHKLVF

SEQ ID NO: 1026778 - protein, 136 aa, Homo sapiens
AGRLSHLQAAYGRRAPSVPSVAVWPEWVPSSPTLVLAQTLWQDVWGLTQQERVQAGQAVHLDPHLPREHPTLVFDVALSPSPCKVPFCHPKKTTPTSSFPLLSIPEAGAAKFILGKPQNWSIWCRGTSSLLPSPDQ

SEQ ID NO: 1026779 - protein, 23 aa, Homo sapiens
METSEGPGLESTGSYLGIQQRSP

SEQ ID NO: 1026780 - protein, 23 aa, Homo sapiens
METSEGPGLESTGSYLGIQQRSP

SEQ ID NO: 1026781 - protein, 23 aa, Homo sapiens
METSEGPGLESTGSYLGIQQRSP

SEQ ID NO: 1026782 - protein, 23 aa, Homo sapiens
METSEGPGLESTGSYLGIQQRSP

SEQ ID NO: 1026783 - protein, 23 aa, Homo sapiens
METSEGPGLESTGSYLGIQQRSP

SEQ ID NO: 1026784 - protein, 23 aa, Homo sapiens
METSEGPGLESTGSYLGIQQRSP

SEQ ID NO: 1026785 - protein, 177 aa, Homo sapiens
IQPFPLHPITRQRQFRTTTYIRQPDDILTLIPSNSSSSAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHLNAEMPEE

SEQ ID NO: 1026786 - protein, 340 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDLNFIYTVSLENIIIGIIGLYLPKLFV

SEQ ID NO: 1026787 - protein, 589 aa, Homo sapiens
RPLFVFFLSSCGEFRTRSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLASLAADFVESKDVCENYAEAQDVFLGMFLYEYARRHSEYSVVLLLRLAKTYETTLEKCCAAADTHECYAKEFDEFKPLVEEPQNLIKQNCELFEQLGECKFQNALLVRYTKKVPQVSTSTLVEVSRNLGKVGANVETFWSKKMACAQDYLFVGLDQICVLPEKTPRSDRVTKCCTEYFVNTRTCFSDLEVDETYASQESNAETFTFHADICTLSVKGRHILKHTALVELVKHKRQATC

SEQ ID NO: 1026788 - protein, 217 aa, Homo sapiens
MKRHFHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLASLAADFVESKDVCENYAEAQDVFLGMFLYEYARRHSEYSVVLLLRLAKTYETTL

SEQ ID NO: 1026789 - protein, 382 aa, Homo sapiens
MKLPEDILTFMPRNSFSLLKGIKLLLQNVAKLLIKLPACCQSSMNFGMKGRLRLPNRDSSVPVSFPKAEFAEVSKLVTDLTKVHTECCHGDLLECADDRADLAKYICENQDSISSKLKECCEKPLLEKSHCIAEVENDEMPADLASLAADFVESKDVCENYAEAQDVFLGMFLYEYARRHSEYSVVLLLRLAKTYETTLEKCCAAADTHECYAKEFDEFKPLVEEPQNLIKQNCELFEQLGECKFQNALLVRYTKKVPQVSTSTLVEVSRNLEKWAANVETFWSKKMACAQDYLFVGLDQICVLPEKTPRSDRVTKCCTEYFVNTRTCFSDLEVDETYASQESNAETFTFHADICTLSVKGRHILKHTALVELVKHKRQATC

SEQ ID NO: 1026790 - protein, 387 aa, Homo sapiens
MKRHFKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLASLAADFVESKDVCENYAEAQDVFLGMFLYEYARRHSEYSVVLLLRLAKTYETTLEKCCAAADTHECYAKEFDEFKPLVEEPQNLIKQNCELFEQLGECKFQNALLVRYTKKVPQVSTSTLVEVSRNLGKVGANVETFWSKKMACAQDYLFVVLDQICVLPEKTPRSDRVTKCCTEYFVNTRTCFSDLEVDETYASQESNAETFTFHADICTLSVKGRHILKHTALVELVKHKRQATC

SEQ ID NO: 1026791 - protein, 585 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLASLAADFVESKDVCENYAEAQDVFLGMFLYEYARRHSEYSVVLLLRLAKTYETTLEKCCAAADTHECYAKVFDEFKPLVEEPQNLIKQNCELFEQLGEYKFQNALLVRYTKKVPQVSTSTLVEVSRNLGKVGANVETFWSKKMACAQDYLFVGLDHLCVLPEKTPRSDRVTKCCTEYFVNTRTCFSDLEVDETYASQESNAETFTFHADICTLSVKGRHILKHTALVELVKHKRQATC

SEQ ID NO: 1026792 - protein, 372 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLASLAADFVESKDVCEGILSTLSCCC

SEQ ID NO: 1026793 - protein, 252 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLISQS

SEQ ID NO: 1026794 - protein, 527 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRQKFGERAFKAWAVARLSQRFPKAEFAEVSKLVTDLTKVHTECCHGDLLECADDRADLAKYICENQDSISSKLKECCEKPLLEKSHCIAEVENDEMPADLASLAADFVESKDVCENYAEAQDVFLGMFLYEYARRHSEYSVVLLLRLAKTYETTLEKCCAAADTHECYAKVFDEFKPLVEEPQNLIKQNCELFEQLGEYKFQNALLVRYTKKVPQVSTSTLVEVSRNLGKVGANVDNILEQKDGLCTSYLFVGLDQLCVLPEKTPRSDRVTKCCTEYFVNTRTCFSDLEVDETYASQESNAETFTFHADICTLSVKGRHILKHTALVELVKHKRQATC

SEQ ID NO: 1026795 - protein, 198 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFWLRISCQMCNCVKCCCAKS

SEQ ID NO: 1026796 - protein, 382 aa, Homo sapiens
MKLPEDILTFMPRNSFSLLKGIKLLLQNVAKLLIKLPACCQSSMNFGMKGRLRLPNRDSSVPVSFPKAEFAEVSKLVTDLTKVHTECCHGDLLECADDRADLAKYICENQDSISSKLKECCEKPLLEKSHCIAEVENDEMPADLASLAADFVESKDVCENYAEAQDVFLGMFLYEYARRHSEYSVVLLLRLAKTYETTLEKCCAAADTHECYAKEFDEFKPLVEEPQNLIKQNCELFEQLGECKFQNALLVRYTKKVPQVSTSTLVEVSRNLGKVGANVETFWSKKMACAQDYLFVGLDQICVLPEKTPRSDRVTKCCTEYFVNTRTCFSDLEVDETYASQESNAETFTFHADICTLSVKGRHILKHTALVELVKHKRQATC

SEQ ID NO: 1026797 - protein, 228 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEYHVVLHEISLINVTNTLNPFGDKLCTVATLRETYGEMADCCAKQEPERNECFLQHKDDNPNLPRLVRPEVDVMCTAFHDNEETFLKKYLYEIARRHPYFYAPELLFFAKRLNLVFTKVAKLCKNFSPLPKFINLG

SEQ ID NO: 1026798 - protein, 363 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLASLAADFVESKDVCKT

SEQ ID NO: 1026799 - protein, 566 aa, Homo sapiens
PFHCCRSASFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFALLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLASLAADFVESKDVCENYAEAQDVFLGMFLYEYARRHSEYSVVLLLRLAKTYETTLEKCCAAADTHECYAKVFDEFKPLVEEPQNLIKQNCELFEQLGEYKFQNALLVRYTKKVPQVSTSTLVEVSRNLGKVGANVETFWSKKMACAQDYLFVGLDHLCVLPEKTPRSDRVTKCCTEYFVNTRTCFSDLEVDETYASQESNAETFTFHADICTLSVKGRHILKHTALVELVKHKRQATC

SEQ ID NO: 1026800 - protein, 382 aa, Homo sapiens; identical to SEQ ID NO: 1026796

SEQ ID NO: 1026801 - protein, 101 aa, Homo sapiens
GIKGEKGNPGVGTQGPRGPPGPAGPSGESRPGSPGAPGSPGPRGPPGHLGVPGPQGPSGQPGYCDPSSCSAYGVRAPHPDQPEFTPVQDELEAMELWGPGV

SEQ ID NO: 1026802 - protein, 55 aa, Homo sapiens
MGATRAKGGPKENRGQNKRRGLPNKKRGGTQAFGQSQGSRGANGGHTGATGANNT

SEQ ID NO: 1026803 - protein, 74 aa, Homo sapiens
LVSKEKKEIQALEPKVQEAPLDQQDLQGRVGLAALGPLALLDQEAHQVIWGFLDPKVLLASLDIVTPHHVLPMV

SEQ ID NO: 1026804 - protein, 74 aa, Homo sapiens; identical to SEQ ID NO: 1026803

SEQ ID NO: 1026805 - protein, 133 aa, Homo sapiens
KKVRTGPGAVAHACNPSTLGGPAGRIPSREWHHFLVVNMKGNDISSGTVLSDYVGSGPPKGTGLHRYVWLVYEQDRPLKCDEPIQIGVLRMGSSHVRSNRSGDHRGKFKVASFRKKYELRAPVAWHVLPGRVG

SEQ ID NO: 1026806 - protein, 121 aa, Homo sapiens
KKVRTGPGAVAHACNPSTLGGPAGRIPSREWHHFLVVNMKGNDISSGTVLSDYVGSGPPKGTGLHRYVWLVYEQDRPLKCDEPILSNRSGDHRGKFKVASFRKKYELRAPVAWHVLPGRVG

SEQ ID NO: 1026807 - protein, 220 aa, Homo sapiens
MTSPVYLSCPRLAYRCHSRLHALNGPLTVASWTYNQVESGPVHPDHKWHETSGAPDEMSPTPGTILYKLGKVLHAQPVFKNRPTMNFVRWVSIQGKLYELGPDHTPGVVLPVRKGSLHILVEEWLLYISLDVSKRGARERSDISSGTVLSDYVGSGPPKGTGLHRYVWLVYEQDRPLKCDEPILSNRSGDHRGKFKVASFRKKYELRAPVAWHVLPGRVG

SEQ ID NO: 1026808 - protein, 121 aa, Homo sapiens; identical to SEQ ID NO: 1026806

SEQ ID NO: 1026809 - protein, 305 aa, Homo sapiens
TDPRLRRGSAVPLGASASPSPASPASSASSPAAGTRDPSVCPTPDPARDMSTPARRRLMRDFKRLQGGSSSRSQAGTPCRRTIIMAVERGYSIRALKGPRYERWNHCKAYNRNATEEYPRLNHYSSIVSKMSHPNVYCAMVVYVWNTTSATEESNPMMCLPFNIHTALLDEPNPNSQHTAKAAQTYQDSTTGEYEQRVNSIVAQSRRDLVERRVMVHSKLTLDNEFLAGGDSLPLPVVTFRSHPQNTVSAFTSRSDPNLYFSLPPYTVYVMSPVRPNTQIIIAKMRQEIMRTRGTGVISKTIVRD

SEQ ID NO: 1026810 - protein, 184 aa, Homo sapiens
MGTMKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIAKSLKELSRESRIFAESCTRQISFLPIQHTAPTMI

SEQ ID NO: 1026811 - protein, 109 aa, Homo sapiens
SCVPTRSLRGHCALSTTAFPRLRIPRTPAPRSRRPPDGVPALRMCVLLVVSANALQPLEHQDPSLRLEPGPSRLPGPSTAAIRTGGLAIARNHPAGVQLIFTSVGREIM

SEQ ID NO: 1026812 - protein, 139 aa, Homo sapiens
SPKTRGQPAYMPPPGIDPPRQALHLARSQPGAMRPAAAYAQDRCPPAPASVLRIPRSHIWFLSHTCHEDDSTERHDCTIACLSSASLPLSLFISDGSVRGTRGVHDIAFVEADNEVDSSSDACTFKITNNAMKISFAKK

SEQ ID NO: 1026813 - protein, 148 aa, Homo sapiens
SPKTRGQPAYMPPPGIDPPRQALHLARSQPGAMPPQLAYAQDRCPPAPASVLRIHRSHIWFLSHTCHEDDSTERHDCTIACLSSASLPLSLFISDGSVRGTRGVHDIAFVEADNEVQAGAARRVPMHGLLRDSAAVTKTAMKISFAKK

SEQ ID NO: 1026814 - protein, 112 aa, Homo sapiens
SPKTRGQPAYMPPPGIDPPRQALHLARSQPGAMPPSASLCSGQMPPSTSLCSENPPESHLGPQPHLPRGSPRAQCCPQRFQITFPASRRSLWNPGGTDICPSLESLDHHIER

SEQ ID NO: 1026815 - protein, 133 aa, Homo sapiens
DAWAVALAADAGSRTLGVMYYKFSGFTQKLAGAWASEAYSPQGLKPVVSTEAPPIIFATPTKLTSDSTVYDYAGKNKVPELQKFFQKADGVPVYLKRGFCDLIKIALTRDRLDVLLDVGKGPIYVRVIGALIS

SEQ ID NO: 1026816 - protein, 132 aa, Homo sapiens
DAWAVALAADAGSRTLGVMYYKFSGFTQKLAGAWASEAYSPQGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 1026817 - protein, 132 aa, Homo sapiens; identical to SEQ ID NO: 1026816

SEQ ID NO: 1026818 - protein, 319 aa, Homo sapiens
MVLPPPDRRHVCLTTLVIMGSMAVMDAYLVEQNQGPRKIGVCIIVLVGDVCFLLVLRYVAVWVGAEVRTAKRGYAMILWFLYIFVLEIKLYFIFQNYKAARRGAADPVARKALTLLLSVCVPGLFLLLVALDRMEYVRTFRKREDLRGRLFWVALDLLDLLDMQASLWEPPRSGLPLWAEGLTFFYCYMLLLVLPCVALSEVSMQGEHIAPQKMMLYPVLSLATVNVVAVLARAANMALFRDSRVSAIFVGKNVVALATKACTFLEYRRQVRDFPPPALSLELQPPPPQRNSVPPPPPPLHGPPGRPHMSSPTRDPLDT

SEQ ID NO: 1026819 - protein, 207 aa, Homo sapiens
MVLPPPDRRHVCLTTLVIMGSMAVMDAYLVEQNQGPRKIGVCIIVLVGDVCFLLVLRYVAVWVGAEVRTAKRGYAMILWFLYIFVLEIKLYFIFQNYKAARRGAADPVARKALTLLLSVCVPGLFLLLVALDRMEYVRTFRKREDLRGRLFWVALDLLDLLDMQASLWEPPRSGLPLWARGALNLSFLLLTIACCLGACPVRFGGFQ

SEQ ID NO: 1026820 - protein, 169 aa, Homo sapiens
EAATEERGPRARLSSATANALYSSNLRDDTKAILEQISAHGQKHRAVPAPSPGPTHNSPELGRPPAAGVLAPDMSDKDKCSAIFRSDSLGTQGRLSRTLPASAEERDRLLRRMESMRKEKRVYSRFEVFCKTEEASSPGAGEGPAEEGTRDSKVGKFVPKILGTFKSKK

SEQ ID NO: 1026821 - protein, 169 aa, Homo sapiens; identical to SEQ ID NO: 1026820

SEQ ID NO: 1026822 - protein, 169 aa, Homo sapiens; identical to SEQ ID NO: 1026820

SEQ ID NO: 1026823 - protein, 169 aa, Homo sapiens; identical to SEQ ID NO: 1026820

SEQ ID NO: 1026824 - protein, 169 aa, Homo sapiens; identical to SEQ ID NO: 1026820

SEQ ID NO: 1026825 - protein, 142 aa, Homo sapiens
MAESSATFTPMAPQIFFYLPLPTHRARPILRIISLLRNLKHRHYPPACNYSNSLHRLCPPVRPNIILRGHSNYKLTIRHPIHWDRPSSMNLRRLLSRQSHPHTILYLSLHLALHYCSPSSTPPPILARNGIKQPPRNHLPFR

SEQ ID NO: 1026826 - protein, 142 aa, Homo sapiens; identical to SEQ ID NO: 1026825

SEQ ID NO: 1026827 - protein, 109 aa, Homo sapiens
TSSRICRAGQLHFVFFGESPSQHLRMMKLRLTPWRLPDPPNHHRTIPSHALLTRRLNRLFINRPHHSRRKLWLNHPLPSRQWRLKYSYICLFLHIGRGLYYGSFLYSET

SEQ ID NO: 1026828 - protein, 684 aa, Homo sapiens
MEDPFEEADQPTTEPGMVLDSVEAGDTTPPTKRKSKFSGFGKIFKPWKWRKKKSSDKFKETSEVLERKISMRKPREELVKRGVLWEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQPKNEADRQAEKTEKINRRLTRKQVKGQLVRLNSLPGRFLRFNEYERVDADYDRAKPNKTLGPKLDPCLDKGCPLGKRLN

SEQ ID NO: 1026829 - protein, 480 aa, Homo sapiens
MEDPFEEADQPTTEPGMVLDSVEAGDTTPPTKRKSKFSGFGKIFKPWKWRKKKSSDKFKETSEVLERKISMRKPREELVKRGVLWEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLNDTYLSHS

SEQ ID NO: 1026830 - protein, 694 aa, Homo sapiens
MGQADVSRPVNPDAVEEADQPTTEPGMVLDSVEAGDTTPPTKRKSKFSGFGKIFKPWKWRKKKSSDKFKETSEVLERKISMRKPREELVKRGVLWEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQPKNEADRQAEKTEKINRRLTRKQVKGQLVRLNSLPGRFLRFNEYERVDADYDRAKPNKTLGPKLDPCLDKGCPLGKRLN

SEQ ID NO: 1026831 - protein, 594 aa, Homo sapiens
MEDPFEEADQPTTEPGMVLDSVEAGDTTPPTKRKSKFSGFGKIFKPWKWRKKKSSDKFKETSEVLERKISMRKPREELVKRGVLWEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPT

SEQ ID NO: 1026832 - protein, 711 aa, Homo sapiens
GGQGWAAAWRPTGQVGFPGEAAVEAEEAAAEIWKQYLTSLNWLIVAWKIHLTSPENLGTVEEADQPTTEPGMVLDSVEAGDTTPPTKRKSKFSGFGKIFKPWKWRKKKSSDKFKETSEVLERKISMRKPREELVKRGVLWEDPEQGGEDPGKPSDAMLKNGHTTPIGNARSSSPVQVEEEPVRLASLRKAIPEEDLKKRLGSTGSQPNSEAESVPENVPKPPLLPPKRPLSSSHEASEGQAKDATSSGGTARFIISTSITTAPAATTAATSLAKTVNLSVTPSPAPRTLPAAPASTNTTATPSLTHMVPAKQPPIPPPKPAHRNSNPVIAELSQAINSGTLLSKPSPPLPPKRGIPSTSVPTLESAAAITTKTPSDEREKSTCSMGSELLPMISPRSPSPPLPTHIPPEPPRTPPFPAKTFQVVPEIEFPPSLDLHQEIPQQEDQKKEVPKRILDQNFGEPHIPSRLPPLPLHIRIQQALTSPLPMTPILEGSHRAHSLLFENSDSFSEDSSTLGRTRSLPITIEMLKVPDDEEEEEQTCPSTFSEEMTPTSVIPKLPQCLREEEEKESDSDSEGPIQYRDEEDEDESYQSALANKVKRKDTLAMKLNHRPSEPELNLNSWPCKSKEEWNEIRHQIGNTLIRRLSQRPTPEELEQRNILQPKNEADRQAEKTEKINRRLTRKQVKGQLVRLNSLPGRFLRFNEYVEGGCSL

SEQ ID NO: 1026833 - protein, 304 aa, Homo sapiens
RPLTAAAPTPVSRIPRPPRQRPAMEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKRRERGLTSDTGSDTKRT

SEQ ID NO: 1026834 - protein, 242 aa, Homo sapiens
MCEDEIAVNKTVAVRDAFLWHIPPAGHKRRHPLELQPQGSPAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKRRERGLTSDTGSDTKRT

SEQ ID NO: 1026835 - protein, 245 aa, Homo sapiens
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKRRERGLTSDTGSDTKRT

SEQ ID NO: 1026836 - protein, 245 aa, Homo sapiens; identical to SEQ ID NO: 1026835

SEQ ID NO: 1026837 - protein, 225 aa, Homo sapiens
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVANSARVSASLECRQT

SEQ ID NO: 1026838 - protein, 232 aa, Homo sapiens
VLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPPAIVVLQQEEYDTPKTRRTDWGFTASSPTKFRLLLQQIHVLSALHRVSSHATLLS

SEQ ID NO: 1026839 - protein, 219 aa, Homo sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPPAIVVLQQEEYDTPKTRRTDWGFTASSPTKFRLLLQQIHVLSALHRVSSHATLLS

SEQ ID NO: 1026840 - protein, 303 aa, Homo sapiens
MGSQGLDWRVGYRDVRRTPTRYRGGIHNRAVAKEEGSSGKADGHYLCEGKHTGILQVRDRPKSGTPRKPCSGPHGVPSEDSTRPMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPPAIVVLQQEEYDTPKTRRTDWGFTASSPTKFRLLLQQIHVLSALHRVSSHATLLS

SEQ ID NO: 1026841 - protein, 692 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYVLGEWGVPGPRKHLGGRGLGWVSPCGGVMGPGSSVGGKSLVGTGGLGKLWGALQPPTTKLHCGSPHRCCIQMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026842 - protein, 621 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026843 - protein, 715 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRPFHAQDGVSAGAELGDGLVALASREPAPHLTGLLEGMFRKLNHLLERLHQSFFLYLLPGLSRFVSIGLYMPAVGFLLLVLGLKISSAPCHLPVTSLQSPQLRLGRVFHPDGGWGTGVSPGSPSGQIPLHLLLGSLIGLALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026844 - protein, 593 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026845 - protein, 244 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVHQLGPAAQSLFF

SEQ ID NO: 1026846 - protein, 726 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKISSAPCHLPVTSLQSPQLWLGRVFHPDGGWGTGVSPGSPSGQIPLHLLLGSLIGLALELWMQLHEAGMGLEEPGGAPGPSVPLPPSQVMDPFCCWNGLLGSDWCLVLQLSLSWWDGGGFGDPLAPGSISKSLCALQGGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026847 - protein, 654 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQELVVGGRGRGPLDMQTACGLPLSPLSYRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026848 - protein, 703 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKVGLPACLRAEGHRVCGRGCLILSCTSKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKISSAPCHLPVTSLQSPQLWLGRVFHPDGGWGTGVSPGSPSGQIPLHLLLGSLIGYALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026849 - protein, 499 aa, Homo sapiens
MVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026850 - protein, 329 aa, Homo sapiens
MVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026851 - protein, 621 aa, Homo sapiens; identical to SEQ ID NO: 1026842

SEQ ID NO: 1026852 - protein, 621 aa, Homo sapiens; identical to SEQ ID NO: 1026842

SEQ ID NO: 1026853 - protein, 499 aa, Homo sapiens; identical to SEQ ID NO: 1026849

SEQ ID NO: 1026854 - protein, 448 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQVTGHGTGPLCPASAGPTRCHPALPSGRG

SEQ ID NO: 1026855 - protein, 666 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRYVISPTSPNACALITDRTLIQQPFPPTWCPCPHHGAYLDVASPPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026856 - protein, 607 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFREHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1026857 - protein, 186 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGWPPPWCPLLRLPSLMGPGPFMLPPFVWGAEPSPAATLLGSLFLWRELQEAPLSLAEGWQLFLAALAQGVLEHHTYGALLFPLLSLGLYPCWLLFWNVLFWK

SEQ ID NO: 1026858 - protein, 161 aa, Homo sapiens
LSMVTPDDVNAIILAQKNMLDRCEKTHEMLLNFSYLSSARLQQMSERFLHHTRTLVEMKRDLDSIFRRIRTLKGKLARQHPEAFSHIPEASFLEEEDEDPIPPSTRTTIATSEQSTGSCDTSPDTVSPSLSPGFEDLSHVQPGSPAINGRSQTDDEEMTGE

SEQ ID NO: 1026859 - protein, 161 aa, Homo sapiens; identical to SEQ ID NO: 1026858

SEQ ID NO: 1026860 - protein, 170 aa, Homo sapiens
GVQAGIRPPPQARTTQKQKSRATMSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGGRITRSGDRDHLG

SEQ ID NO: 1026861 - protein, 347 aa, Homo sapiens
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 1026862 - protein, 347 aa, Homo sapiens; identical to SEQ ID NO: 1026861

SEQ ID NO: 1026863 - protein, 347 aa, Homo sapiens; identical to SEQ ID NO: 1026861

SEQ ID NO: 1026864 - protein, 93 aa, Homo sapiens
GEHALRNGFFYWMKNPQHKDIGQYASVRNVLDEDNDNVGQPNEYDLNDSFLDDEEEDYEPTDEDSDWEPGKEDEEKEDVEELLKEAKRFMKRK

SEQ ID NO: 1026865 - protein, 93 aa, Homo sapiens; identical to SEQ ID NO: 1026864

SEQ ID NO: 1026866 - protein, 233 aa, Homo sapiens
RACKRSQRAKGETLPPVQLGSSLRDVLLLGAVSGKTKGRGLVMEDCAPEMIEMPTSTLEEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRLEVQCPVEKHQLS

SEQ ID NO: 1026867 - protein, 341 aa, Homo sapiens
RACKRSQRAKGETLPPVQLGSSLRDVLLLGAVSGKTKGRGLVMEDCAPEMIEMPTSTLEEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPEADSAHNISAHRMRKLNAYYPGCTHLHLYVAYKQLTCNAMRNVLDEDNDNVGQPNEYDLNDSFLDDEEEDYEPTDEDSDWEPGKEDEEKEDVEELLKEAKRFMKRK

SEQ ID NO: 1026868 - protein, 413 aa, Homo sapiens
RACKRSQRAKGETLPPVQLGSSLRDVLLLGAVSGKTKGRGLVMEDCAPEMIEMPTSTLEEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPVRNVLDEDNDNVGQPNEYDLNDSFLDDEEEDYEPTDEDSDWGGRRRRKKKVMVRKEDGDEDEGKLRSVTGKRAVKMMTMTDVDTKKQKTTRMTRTAKKEQLSKTKGRGTNTLKSGSEYKRAPSEEGRPPTGQAPEMKAHQNNQMKMAQRGTADNTAETKNQKEGAKTNTETEEQKNTK

SEQ ID NO: 1026869 - protein, 97 aa, Homo sapiens
WEGPLALKGAALFILAAPYFICPGSSMVWPMEGGAGPQIPPAKLSLSPRGALFSSFPNFPSPRTRLDSPLRLQEGRRGESPTPSSLWPQPPCPPPGI

SEQ ID NO: 1026870 - protein, 97 aa, Homo sapiens; identical to SEQ ID NO: 1026869

SEQ ID NO: 1026871 - protein, 96 aa, Homo sapiens
GLPAPLQRKWLFAKVVENSKPPTRSGSALSHACFCYALICSIPVFTYIVLVTSLRYHLFIWSVFSPKLLYEGMHLLITAAVCVFFTAMDQTRLTQS

SEQ ID NO: 1026872 - protein, 150 aa, Homo sapiens [sequence omitted]

SEQ ID NO: 1026873 - protein, 45 aa, Homo sapiens
MTGPQQRGRTGLAVMSWSETKATEAPLPPKCSEAARSGWCWPVRG

SEQ ID NO: 1026874 - protein, 514 aa, Homo sapiens
MREQLRFLHLNTVQLSKLLQENVPSYEKDPGFEQFKMSERLHGNWIRLYLEEKHSEVLFNLGSKVLRQYLDALKTLSLSLSAQVAQYDIYSMMVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQVGFHYYHG

SEQ ID NO: 1026875 - protein, 577 aa, Homo sapiens
LILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQVGFHYYHG

SEQ ID NO: 1026876 - protein, 577 aa, Homo sapiens; identical to SEQ ID NO: 1026875

SEQ ID NO: 1026877 - protein, 577 aa, Homo sapiens; identical to SEQ ID NO: 1026875

SEQ ID NO: 1026878 - protein, 695 aa, Homo sapiens
LILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETLWVSAMLHDSFCYPLHMTITDYACIEPVTAGVKPTIYTADFSPKLLYEGMHLLITAAVCVFFTAMDQTRLTQS

SEQ ID NO: 1026879 - protein, 466 aa, Homo sapiens
LILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISK

SEQ ID NO: 1026880 - protein, 388 aa, Homo sapiens
MFSFFSGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTR

SEQ ID NO: 1026881 - protein, 289 aa, Homo sapiens
MFSFFSGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVLTLLLLSVPQALRRKAELEVPLSSPGFSLLFYLVILVLSAVHVIVCTSAESSCYFCGLSWLAAGGVMVLASALLCVIVSVLTNVLVGGNTPRKTLVEHLVCATCWQCPGQGASGKDVEQPYPRPLGVPTQVFTSVLSGQMPQFLES

SEQ ID NO: 1026882 - protein, 112 aa, Homo sapiens
ALYSKGKSYWSLFENKSVVTCVICKWHVLIHIFFLINTQWFSTESCLLLLRTDLFYSSFHVHRFGDISALSFIYMECIFSKTSLRGNAPAHYSCCLCILHGNGSNQTHTVLD

SEQ ID NO: 1026883 - protein, 577 aa, Homo sapiens; identical to SEQ ID NO: 1026875

SEQ ID NO: 1026884 - protein, 206 aa, Homo sapiens
MGPSIWPAVCLHVSFPEKPRRGDFGWSPLQSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQVGFHYYHG

SEQ ID NO: 1026885 - protein, 109 aa, Homo sapiens
MTRLSLGEHVRIPGATLVAQFFWKILSSDHKAELSVLAALSLLVVFVLVQRGCSPVSKAALALGLLGVYCYRAAIGSVRFPWRPDSKDISNRATPTTLPPWTSPQASWA

SEQ ID NO: 1026886 - protein, 577 aa, Homo sapiens; identical to SEQ ID NO: 1026875

SEQ ID NO: 1026887 - protein, 577 aa, Homo sapiens; identical to SEQ ID NO: 1026875

SEQ ID NO: 1026888 - protein, 355 aa, Homo sapiens
MREQLRFLHLNTVQLSKLLQENVPSYEKDPGFEQFKMSERLHGNWIRLYLEEKHSEVLFNLGSKVLRQYLDALKTLSLSLSAQVAQYDIYSMMVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSHSENALITAKMAPSHS

SEQ ID NO: 1026889 - protein, 604 aa, Homo sapiens
MSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 1026890 - protein, 260 aa, Homo sapiens [sequence omitted]

SEQ ID NO: 1026891 - protein, 260 aa, Homo sapiens [sequence omitted]

SEQ ID NO: 1026892 - protein, 260 aa, Homo sapiens [sequence omitted]

SEQ ID NO: 1026893 - protein, 107 aa, Homo sapiens
MLALLGLSQALNILLGLKGLAPAEISAVCEKGNFNVAHGLAWSYYIGYLRLILPELQARIRTYNQHYNNLLRGAVSQRLYILPPTPLEYSLSLAVSLYSTPFSTVLF

SEQ ID NO: 1026894 - protein, 260 aa, Homo sapiens [sequence omitted]

SEQ ID NO: 1026895 - protein, 164 aa, Homo sapiens [sequence omitted]

SEQ ID NO: 1026896 - protein, 166 aa, Homo sapiens
MADPNIRFLDKLPQQTGDRAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 1026897 - protein, 113 aa, Homo sapiens [sequence omitted]

SEQ ID NO: 1026898 - protein, 95 aa, Homo sapiens
MRGKPKAHAVSDSRHLREERSQIDKVTKSRRPTLVGEQFDRPNPNCTEGLDSIMGKPKGTSQEKAQIAMAQRNRMQKTHNRAKRDDTQEDLTPKE

SEQ ID NO: 1026899 - protein, 294 aa, Homo sapiens
MLALLGLSQALNILLGLKGLAPAEISAVCEKGNFNVAHGLAWSYYIGYLRLILPALEYSGDKISAHCNLCSQVQVILLLTSLNSSGLPELQARIRTYNQHYNNLLRGAVSQRLYILLPLDCGVPDNLSMADPNIRFLDKLPQQTGDRAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 1026900 - protein, 304 aa, Homo sapiens
YGSGTGLKAGVHGVEPIMSWNSGFGNGKRGIKSGAGWEALEEEEEFSGVLDGGPPATSCCPQGLAPAEISAVCEKGNFNVAHGLAWSYYIGYLRLILPELQARIRTYNQHYNNLLRGAVSQRLYILLPLDCGVPDNLSMADPNIRFLDKLPQQTGDRAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 1026901 - protein, 110 aa, Homo sapiens
SFSSRSDKKGPKTIAEMRKQDLAKDTDPLKAEAPGLDEGKELGHPGPAVHLAHSAVGRGEPAGTPVGMADLVAPEQVKKHYRRAVLAVHPDQGCGAAVRAARQDDLHGAE

SEQ ID NO: 1026902 - protein, 110 aa, Homo sapiens; identical to SEQ ID NO: 1026901

SEQ ID NO: 1026903 - protein, 110 aa, Homo sapiens; identical to SEQ ID NO: 1026901

SEQ ID NO: 1026904 - protein, 110 aa, Homo sapiens; identical to SEQ ID NO: 1026901

SEQ ID NO: 1026905 - protein, 73 aa, Homo sapiens
RPRDRLREDDRGHEEPPKPLMLPLLPKEQLIHAPPAIVTSVIYLVFRAWPLEPRHVVGHAAGAHGPWCLHRTL

SEQ ID NO: 1026906 - protein, 145 aa, Homo sapiens
MPPEGGQIIPPARRCLYASVLTATPRLMEPIYLVEIQCPKQVVGGIYRVFNRKRGPVFEESQVAGPPMFVVKAYLAVNESFGFTPYLRSNTGGQAFPQCVFSPWQILPGDPFDNNNRPNQVVGETRQRKGLKKGIPALGNFLDKL

SEQ ID NO: 1026907 - protein, 271 aa, Homo sapiens
MSVVLEFHFDTQRLHLPTQVADKKAYKMKWRSQIRGDPLCLEGPEMWTVTGCTMDWKKGKNVTCQEPSRKGRSIRVEALLDTITETMYPHESLLQLLQSIESIRGWRITWMKILNSALASDFEIGHFFRERIVPTVLCCTSLEEAIRRTDDNYEEGEEGEEEELEKVTRREKTRDDAQMKPKVYFCLLIIPYVSRREPSSRRNARQKEDATQGGWHSGCGIRLGRGSVVPRKSGTEYTTNGEGSNTSLLTNGYDSMKRTRVDDPTGTNRPG

SEQ ID NO: 1026908 - protein, 138 aa, Homo sapiens
MAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRYTQGIVDDLENSESLYAHQPCQR

SEQ ID NO: 1026909 - protein, 86 aa, Homo sapiens
MAEREEDDDTEEAWMQLRPTEPLPSQCCGSGCSPCVFDLYHRDLARWEAAQASKDRSLLRGPESQRGIVDDLENSESLYAHQPCQR

SEQ ID NO: 1026910 - protein, 137 aa, Homo sapiens
MAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRYTQVAGGPKLHSPALLFASCWP

SEQ ID NO: 1026911 - protein, 218 aa, Homo sapiens
APPPRVCPGKGLAGGRPSGPLLPEGSSRLELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 1026912 - protein, 163 aa, Homo sapiens
AGRRPVPRAADLSPQPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 1026913 - protein, 441 aa, Homo sapiens
MFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGSLYLTSSLPGGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLELLNRVQSSGAHDQRGLLRKEDLVLPEFLQLPAQGPAPRRPTTDQISSPAHRGILELHHRLSPLTATQQSRTAAWHPAGRACHGSALHALSVP

SEQ ID NO: 1026914 - protein, 441 aa, Homo sapiens; identical to SEQ ID NO: 1026913

SEQ ID NO: 1026915 - protein, 467 aa, Homo sapiens
MPGKPKHLGVPNGRMVLAVSDGELSSTTGPQGQGEGRGSSLSIHSLPSGPSSPFPTEEQPVASWALSFERLLQDPLGLAYFTEFLKKEFSAENVTFWKACERFQQIPASDTQQLAQEARNIYQEFLSSQALSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQAWWSC

SEQ ID NO: 1026916 - protein, 241 aa, Homo sapiens
MLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 1026917 - protein, 692 aa, Homo sapiens
MPGKPKHLGVPNGRMVLAVSDGELSSTTGPQGQGEGRGSSLSIHSLPSGPSSPFPTEEQPVASWALSFERLLQDPLGLAYFTEFLKKEFSAENVTFWKACERFQQIPASDTQQLAQEARNIYQEFLSSQALSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGTWWMSWGSERLGQWGWGPFRVASESLELRQGAGCHWAWNRKDGGWGVKGAGTWGPQAIGAGARKAVATVRQWDYRGLAYEAGLLGGPLMLWLASRPGGAAEPGAEQRGPRPEGPSEERGPGTSRISAAARPRAQLRGDPTTDQISSPAHRGILELHHRLSPLTATQQSRTAAWHPAGRACHGSALHALSVP

SEQ ID NO: 1026918 - protein, 435 aa, Homo sapiens
GQPQGPGLGAGSPAPPPQPRLTCSGVAPQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 1026919 - protein, 337 aa, Homo sapiens
MGEGGGLFAFIAPSSLELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 1026920 - protein, 201 aa, Homo sapiens
MFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQVGT

SEQ ID NO: 1026921 - protein, 208 aa, Homo sapiens
MPRGYNWAFLVGRSQQPGLVLIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGQLRAP

SEQ ID NO: 1026922 - protein, 208 aa, Homo sapiens; identical to SEQ ID NO: 1026921

SEQ ID NO: 1026923 - protein, 180 aa, Homo sapiens
MPRGYNWAFLVGRSQQPGLVLIPGTCLLPEVTEEDQGRICVVIDLDETLVHSSFKPINNADFIVPIEIEGTTHQVYVLKRPYVDEFLRRMGELFECVLFTASLAKGCYVKDLSRLGRDLRKTLILDNSPASYIFHPENAVPVQSWFDDMADTELLNLIPIFEELSGAEDVYTSLGQLRAP

SEQ ID NO: 1026924 - protein, 208 aa, Homo sapiens; identical to SEQ ID NO: 1026921

SEQ ID NO: 1026925 - protein, 104 aa, Homo sapiens
SGGDSCLQASDRSSGFGWGGKGSEMARDHLLLFLSRICSSVSSTSSTQVRDSGLVSTQKPGSCDPCQLHGQGDVHSPWCLASHLPDLGSHLFPILVEGLLCARH

SEQ ID NO: 1026926 - protein, 106 aa, Homo sapiens
LGEIVASRLKTEAVGLDGVGKAVRWHVTTSFSSSVGSAPVSPVPVLPEIPGTCLLPEVTEEDQGRICVVIDLDETLVHSSFKPINNADFIVPIEIEGTTHQVYRVV

SEQ ID NO: 1026927 - protein, 208 aa, Homo sapiens
LRLGPLIHWKPGEGYSQFSGSVGSQGPQASSQVAQEAGLQGLRAPCCCVTGEGTQYCKTFITGMPPTGCSALPQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGQLRAP

SEQ ID NO: 1026928 - protein, 194 aa, Homo sapiens
MPRGYNWAFLVGRSQQPGLVLIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELGC

SEQ ID NO: 1026929 - protein, 228 aa, Homo sapiens
LPFRSAVILLQEPQVRSSACAPSRNGMVLNAPLPQWTWQRRVATWFNQPARKIRRRKARQCQGAAALVPRPASGPIRPIVRCPTVRYHTKVRAGRGFSLEELRVAGIHKKVARTIGISVDPRRRNKSTESLQANVQRLKEYRSKLILFPRKPSAPKKGDSSAEELKLATQLTGPVMPVRNVYKKEKARVITEEEKNFKAFASLRMARAQRPALRHTGKKSQGSRRTGC

SEQ ID NO: 1026930 - protein, 228 aa, Homo sapiens; identical to SEQ ID NO: 1026929

SEQ ID NO: 1026931 - protein, 228 aa, Homo sapiens; identical to SEQ ID NO: 1026929

SEQ ID NO: 1026932 - protein, 149 aa, Homo sapiens
MQHAYWELKREMSNLHLVTQVQAELLRKLKTSTAIKKACAPVGCSEDLGRDSTKLHLMNFTATYTRHPPLLPNGKALCHTTSSPLPGDVKVLSEKAILQSWTDNERSIPNDGTCFQEHSSYGRNSLEDNSWVFPSPPKSSETAFGETKN

SEQ ID NO: 1026933 - protein, 81 aa, Homo sapiens
SDLKIELQKAKQTDPYQEDNLKSRDLQKLSISSDNMQHAYWELKREMSNLHLVTQVQAELLRKLKTSTAIKKGKSLFTGNH

SEQ ID NO: 1026934 - protein, 224 aa, Homo sapiens
SDLKIELQKAKQTDPYQEDNLKSRDLQKLSISSDNMQHAYWELKREMSNLHLVTQVQAELLRKLKTSTAIKKACAPVGCSEDLGRDSTKLHLMNFTATYTRHPPLLPNGKALCHTTSSPLPGDVKVLSEKAILQSWTDNERSIPNDGTCFQEHSSYGRNSLEDNSWVFPSPPKSSETAFGETKSKTLPLPKPSTTGITWDQHIQNCLLYRINMGQKIHGSSPMQ

SEQ ID NO: 1026935 - protein, 488 aa, Homo sapiens
RAANAASSQWPNEVEMMTTRSLITIAHVRKLRNIGSGQRRHSRPRQSCGREAIVISRDAQARPPCGIRYLSSYDTGPPDTLQCKQVATWQQLELKKACPPGLNEIEIRAKSSIRFTSAVTGDGCKSHTGAWGKPVIEYKTPKTSRMPIINVAPLDVGAPDQELGFEVGPVCFLETSLHPNLAPSHPTNFPPNPETDKQPKLNPLKSQKMGDNFTWTLENIFFLCIHLSNLVFIFDQPNMTKNQKCIHPYQKKKFKKGIYLINFLKKEAGPPGLKTHAGVGPFVARGVFETPMACPFELLFSKPPWGPSPPLLPKFWSPQKTQGNIVWSAQQIKGNAQTPMGAPTLQPVRARQRTPRPWGTWGSLQSCQKKPCAKSGGLPRGSVENIVPYGDMEGGQCRGEATKATINGDSRRSSQQGAHGYEITAEKPPVGRNRVSNTLGCPQGTGTGAEHGAVLGVTGVLRKKYPGLVLEVPRDKLTAAGMKTDEGP

SEQ ID NO: 1026936 - protein, 506 aa, Homo sapiens
RAANAASSQWPNEVEMMTTRSLITIAHVRKLRNIGSGQRRHSRPRQSCGREAIVISRDAQARPPCGIRYLSSYDTGPPDTLQCKQVATWQQLELKKACPPGLNEIEIRAKSSIRFTSAVTGDGCKSHTGAWGKPVIEYKTPKTSRMPIINVAPLDVGAPDQELGFEVGPVCFLETSLHPNLAPSHPTNFPPNPETDKQPKLNPLKSQKMGDNFTWTLENIFFLCIHLSNLVFGHVRLVKDKNKFEEMNAKIFDQPNMTKNQKCIHPYQKKKFKKGIYLINFLKKEAGPPGLKTHAGVGPFVARGVFETPMACPFELLFSKPPWGPSPPLLPKFWSPQKTQGNIVWSAQQIKGNAQTPMGAPTLQPVRARQRTPRPWGTWGSLQSCQKKPCAKSGGLPRGSVENIVPYGDMEGGQCRGEATKATINGDSRRSSQQGAHGYEITAEKPPVGRNRVSNTLGCPQGTGTGAEHGAVLGVTGVLRKKYPGLVLEVPRDKLTAAGMKTDEGP

SEQ ID NO: 1026937 - protein, 279 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLKDAAKVCREFHRSVSKGEVRFSGRGSLARQPNAPVGGTLLISPLPFNMKIFTPPMQSKNASVLVKTQGGSFCSCRHAFPLSTPGA

SEQ ID NO: 1026938 - protein, 237 aa, Homo sapiens
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRDAAKVCREFHRSVSKGEVRFSGRGSLARQPNAPVGGTLLISPLPFNMKIFTPPMQSKNASVLVKTQGGSFCSCRHAFPLSTPGA

SEQ ID NO: 1026939 - protein, 194 aa, Homo sapiens
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMGRQARKFGSE

SEQ ID NO: 1026940 - protein, 194 aa, Homo sapiens; identical to SEQ ID NO: 1026939

SEQ ID NO: 1026941 - protein, 180 aa, Homo sapiens
LQDSAREIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMGRQARKFGSE

SEQ ID NO: 1026942 - protein, 176 aa, Homo sapiens
MGEIKVSPDYNWFRGTVPLKKIIVDDDDSKIWSLYDAGPRSIRCPLIFLPPVSGTADVFFRQILALTGWGYRVIALQYPVYWDHLEFCDGFRGGFLAQKFAEYTHKSPRVHSLILCNSFSDTSIFNQTWTANSFWLMPAFMLKKIVLGNFSSGPVDPMMADAIDFMGRQARKFGSE

SEQ ID NO: 1026943 - protein, 167 aa, Homo sapiens
MGEIKVSPDYNWFRGTVPLKKIIVDDDDSKIWSLYDAGPRSIRCPLIFLPPVSGTADVFFRQILALTGWGYRVIAVHLFGASLGGFLAQKFAEYTHKSPRVHSLILCNSFSDTSIFNQTWTANSFWLMPAFMLKKIVLGNFSSGPVDPMMADAIDFMGRQARKFGSE

SEQ ID NO: 1026944 - protein, 194 aa, Homo sapiens; identical to SEQ ID NO: 1026939

SEQ ID NO: 1026945 - protein, 257 aa, Homo sapiens
HASARQLSGGRAGGARRPKLAWPRAPPPQRPASRTHRAACCARGSRVLRRPPRPGPSRLHGPRSYWSEERPPEGGEGTWGRPRQIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMGRQARKFGSE

SEQ ID NO: 1026946 - protein, 194 aa, Homo sapiens; identical to SEQ ID NO: 1026939

SEQ ID NO: 1026947 - protein, 160 aa, Homo sapiens
ILLNPSSRSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 1026948 - protein, 165 aa, Homo sapiens
AIVEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 1026949 - protein, 165 aa, Homo sapiens; identical to SEQ ID NO: 1026948

SEQ ID NO: 1026950 - protein, 165 aa, Homo sapiens; identical to SEQ ID NO: 1026948

SEQ ID NO: 1026951 - protein, 165 aa, Homo sapiens; identical to SEQ ID NO: 1026948

SEQ ID NO: 1026952 - protein, 165 aa, Homo sapiens; identical to SEQ ID NO: 1026948

SEQ ID NO: 1026953 - protein, 160 aa, Homo sapiens; identical to SEQ ID NO: 1026947

SEQ ID NO: 1026954 - protein, 165 aa, Homo sapiens; identical to SEQ ID NO: 1026948

SEQ ID NO: 1026955 - protein, 165 aa, Homo sapiens; identical to SEQ ID NO: 1026948

SEQ ID NO: 1026956 - protein, 116 aa, Homo sapiens
NKLGTLGLRVFNSQREHPLGKAKPSCEQPFNLAHGVFFFFFLFFFFFFFFELLFVFRSTVHENPFLTSLGKLTLSLFPPSIRRMYLNECWSVGHFVNYGYWVLNCLILPCECCIRL

SEQ ID NO: 1026957 - protein, 165 aa, Homo sapiens; identical to SEQ ID NO: 1026948

SEQ ID NO: 1026958 - protein, 165 aa, Homo sapiens; identical to SEQ ID NO: 1026948

SEQ ID NO: 1026959 - protein, 82 aa, Homo sapiens
ILLNPSSRSPDLQSMEQIRRIMRPTDVPDTGLLCDLLWSDPDKDVQGWGENDRGVSFTFGADVVSKFLNRHDLDLICRAHQV

SEQ ID NO: 1026960 - protein, 280 aa, Homo sapiens
MSAELGVEVLHCVAVNGGACHSGLWSADCAGSGISQPLQPPAYVASQAETKTCRTVVTQRPMDMGQQHFCARTTFRELLEKASNPKILSLCPEIKWHFIGHLQKQNVNKLMAVPNLFMLETVDSVKLADKVNSSWQRKGSPERLKVMVQINTSGEGSKHGLPPSETIAIVEHINAKCPNLEFVGLMTIGSFGHDLSQGPNPDFQLLLSLREELCKKLNIPADQVELSMGMSADFQHAVEVGSTNVRIGSTIFGERDYSKKPTPDKCAADVKAPLEVAQEH

SEQ ID NO: 1026961 - protein, 290 aa, Homo sapiens
MSAELGVEVLHCVAVNGGACHSGLWSADCAGSGISQPLQPPAYVAVKQKPNLQDMVTQRPMDMGQQHFCARTTFRELLEKASNPKILSLCPEIKWHFIGHLQKQNVNKLMAVPNLFMLETVDSVKLADKVNSSWQRKGSPERLKVMVQINTSGEEIYLFSVSLLERGKHGLPPSETIAIVEHINAKCPNLEFVGLMTIGSFGHDLSQGPNPDFQLLLSLREELCKKLNIPADQVELSMGMSADFQHAVEVGSTNVRIGSTIFGERDYSKKPTPDKCAADVKAPLEVAQEH

SEQ ID NO: 1026962 - protein, 280 aa, Homo sapiens; identical to SEQ ID NO: 1026960

SEQ ID NO: 1026963 - protein, 280 aa, Homo sapiens; identical to SEQ ID NO: 1026960

SEQ ID NO: 1026964 - protein, 280 aa, Homo sapiens; identical to SEQ ID NO: 1026960

SEQ ID NO: 1026965 - protein, 280 aa, Homo sapiens; identical to SEQ ID NO: 1026960

SEQ ID NO: 1026966 - protein, 231 aa, Homo sapiens
CKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRHHEHRQIVDDAPSHASMAYSS

SEQ ID NO: 1026967 - protein, 242 aa, Homo sapiens
CKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPHLPP

SEQ ID NO: 1026968 - protein, 206 aa, Homo sapiens
LSTSCPNTPVIPKGNESAKSRPSFGMCFAYKMLGRCFVLISLSIRAGVQAHHRPRVLTNFLGRARSLEKVGVSGVCAPLTKRIPFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 1026969 - protein, 88 aa, Homo sapiens
AAAYYYYCSEFKLLTMYGDMFCAGHPSLKQDACQGDSGGVFAVRDPNTDRWVATGIVSWGIGCSRGYGFYTKVLNYVDWIKKEMEEED

SEQ ID NO: 1026970 - protein, 242 aa, Homo sapiens; identical to SEQ ID NO: 1026967

SEQ ID NO: 1026971 - protein, 242 aa, Homo sapiens; identical to SEQ ID NO: 1026967

SEQ ID NO: 1026972 - protein, 242 aa, Homo sapiens; identical to SEQ ID NO: 1026967

SEQ ID NO: 1026973 - protein, 242 aa, Homo sapiens; identical to SEQ ID NO: 1026967

SEQ ID NO: 1026974 - protein, 242 aa, Homo sapiens; identical to SEQ ID NO: 1026967

SEQ ID NO: 1026975 - protein, 102 aa, Homo sapiens
KINFPSVPQALPGGGGAPTVITAAHTLYPKEHEAQSNASLDVFLGHTNVEELMKLGNHPIRRVSVHPDYRQDESYNFEGDIALLELENSVTLGPNLLPHLPP

SEQ ID NO: 1026976 - protein, 264 aa, Homo sapiens
MVKSSLQRILNSHCFAREKEGDKPSATIHASRTMPLLSLHSRGAAAVRVPGSPSTAVVTRVRGLGGAPDAPHPPLKIPGGRGNSQRDHNLSANLFYSDDRLNVTEELTSNDKTRILNVQSRLTDAKRINWRTVLSGGSLYIEIPGGALPEGSKDSFAVLLEFAEEQLRADHVFICFHKNREDRAPLLRTFSFLGFEIVRPGHPLVPKRPDACFMAYTFEKESFGRGGGVGPPRGWASGPWGPPLSTGWVGTVNSLISPGFVRML

SEQ ID NO: 1026977 - protein, 197 aa, Homo sapiens
MVKSSLQRILNSHCFAREKEGDKPSATIHASRTMPLLSQHSRGAAAARVLGLPLIAVVTRVRGLGGAPDAPHPPLKIPGGRGNSQRDHSLSASILYSDERLNVTEEPTSNDKTRVLSIQSTLTEAKQVTWRAVWSGGSLYIEIPGGALPEGSKDSFAVLLEFAEEHSRLTTFSSASPRTVRTEPPYSEPSAFLALRL

SEQ ID NO: 1026978 - protein, 264 aa, Homo sapiens; identical to SEQ ID NO: 1026976

SEQ ID NO: 1026979 - protein, 264 aa, Homo sapiens; identical to SEQ ID NO: 1026976

SEQ ID NO: 1026980 - protein, 243 aa, Homo sapiens
RAAAAARRDAAEVFLVSDPSGRMVKSSLQRILNSHCFAREKEGDKPSATIHASRTMPLPEPARRQRRPQRREGLPPRAVVTRVRGLGGAPDAPHPPLKIPGGRGKIARGIPASRPRRCYSDQRLSVTEELTPSGQTRVLHVRSRLSDARQVSWRAVLSANRLYVELPAGALPEGCKDSLAVLLEFAEEQLRAEHVFICFPKNREDRAALLRTFGFLGFELVRPGHPLVPARPDACFLAYSLQG

SEQ ID NO: 1026981 - protein, 295 aa, Homo sapiens
IQKLSKKNPPTPPQFPPSPPPPPPPTHPPHLFLLSHPTPPILKSSLHPINTLFPTHNQPHKPTPTIPTPTIPLTLNTPTTTSTSLTAVVTRVRGLGGAPDAPHPPLKIPGGRGNSQRDHNLSANLFYSDDRLNVTEELTSNDKTRILNVQSRLTDAKRINWRTVLSGGSLYIEIPGGALPEGSKDSFAVLLEFAEEQLRADHVFICFHKNREDRAPLLRTFSFLGFEIVRPGHPLVPKRPDACFMAYTFEKESFGRGGGVGPPRGWASGPWGPPLSTGWVGTVNSLISPGFVRML

SEQ ID NO: 1026982 - protein, 321 aa, Homo sapiens
HASSPRRGGRLGAGGQRCLRRPQLPGTALLCACLLCQPPLQPPPPTPQRGLLLGPAAGPVAHRAPTLRPPGVPSPSGPLAPGLGSCWCPGRPAPSSVLRVCPTLLPELGGEPGTVPGCLGAQPGQGELSSEGWSQTPGLMQSSCLGLPMCWNYRYELPRSAQTQGSSPPYYVLCWPPVKGENSRQAKMFYREAAKSFPQWMTQSPSQTTPQIQPQGTLLLRVPLGQGMQSTRRWSSEDGTLPESCVSLGKLTRLSEPVSRCTGLCTELCGDHADIAAHPPSCSWDRPFTPASPPATGLSEGADSSPRTSHCPFEGLSFLTL

SEQ ID NO: 1026983 - protein, 139 aa, Homo sapiens
RIVFLLPFPPLLVVLFVSVVCRALSGVSVPFSPAVLWFSFSSLSFFAPVLLCGRGCVCVSPFVCPPCVFVVSSLLPRDSSVCPSCFVFLFFSFFFFFSCCFFSFFFFVVCLFVFFKMNKLKTFISSKKNVWHLEFSSCK

SEQ ID NO: 1026984 - protein, 134 aa, Homo sapiens
MFYREAAKSFPQWMTQSPSQTTPQIQPQGTLLLRVPLGQGMQSTRRWSSEDGTLPESCVSLGKLTRLSEPVSRCTGLCTELCGDHADIAAHPPSCSWDRPFTPASPPATGLSEGADSSPRTSHCPFEGLSFLTL

SEQ ID NO: 1026985 - protein, 69 aa, Homo sapiens
IIPEMGIICDGTNLIAPDSTRTPSVTPVLTKMANNEMANAWSIPGPRFFAFQAALKIMKPIIASVSTNC

SEQ ID NO: 1026986 - protein, 251 aa, Homo sapiens
MATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1026987 - protein, 367 aa, Homo sapiens
RTRGARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENRYMQVAERRRNLQGFHIKMVL

SEQ ID NO: 1026988 - protein, 142 aa, Homo sapiens
GPIRLMVGLEADLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1026989 - protein, 520 aa, Homo sapiens
RTRGARVAVVQHAPSESVDNASMPPVKVEFSLTDDGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1026990 - protein, 455 aa, Homo sapiens
RTRGARVAVVQHAPSESVDNASMPPVKVEFSLTDDGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETGEL

SEQ ID NO: 1026991 - protein, 243 aa, Homo sapiens
RTRGARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPDLPPNKKEFSS

SEQ ID NO: 1026992 - protein, 403 aa, Homo sapiens
PDVIYPQEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1026993 - protein, 335 aa, Homo sapiens
IATNTNLTQNKKTYSDPDNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1026994 - protein, 520 aa, Homo sapiens; identical to SEQ ID NO: 1026989

SEQ ID NO: 1026995 - protein, 99 aa, Homo sapiens
ELVTEFISQQCLSSSTINLMVSTEPLALTETDICKLPKDEGTCRDFILKWYYDPNTKSCARFWYGGCGGNENKFGSQKECEKVCAPVLAKPGVISVMGT

SEQ ID NO: 1026996 - protein, 520 aa, Homo sapiens; identical to SEQ ID NO: 1026989

SEQ ID NO: 1026997 - protein, 223 aa, Homo sapiens
RTRGARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTFLIPVRSS

SEQ ID NO: 1026998 - protein, 520 aa, Homo sapiens; identical to SEQ ID NO: 1026989

SEQ ID NO: 1026999 - protein, 336 aa, Homo sapiens
YDFKKKKVCKTCAPRQAPDNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1027000 - protein, 271 aa, Homo sapiens
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 1027001 - protein, 203 aa, Homo sapiens
MGNGGRSGLQQGKGNVDGVAATPTAASASCQYRCIECNQEAKELYRDYNHGVLKITICKSCQKPVDKYIEYDPVIILINAILCKAQGRSMDYILSLQVSSRLHTIHDRIEPPCHTCLVVACLLKALSLRVGWQAFDRIPNARIVLASVEWTYCSPEYCVIGRVGECVLTKGTVVYGRFGLGMFRKTKNFVALYLGQLLGPICV

SEQ ID NO: 1027002 - protein, 340 aa, Homo sapiens
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALVNLLQKHWMSFHLKAFEVALPVPGMPVPLMPRCLTPAYPSRVGYNDTFYMKCTSDTPDLLFRLYFVLLIEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 1027003 - protein, 271 aa, Homo sapiens; identical to SEQ ID NO: 1027000

SEQ ID NO: 1027004 - protein, 286 aa, Homo sapiens
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGQDSNQNTAPDDLIRYAKEWDFYRMFAIAALGWSAVAQSQLTAALNSWAQAILLPRPPRSAGTTEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 1027005 - protein, 129 aa, Homo sapiens
MFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 1027006 - protein, 129 aa, Homo sapiens; identical to SEQ ID NO: 1027005

SEQ ID NO: 1027007 - protein, 222 aa, Homo sapiens
MFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGYPPPPPRPLPPPPPCPLKPYKPTSSFLLSKMKQRLETLSEKESNDNSGGYPPPQMHPRDKPFTYRYSQSHIETPTWTQGMLLQRLNDMQQVKVYTLYTRPGKRS

SEQ ID NO: 1027008 - protein, 304 aa, Homo sapiens
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALGWSAVAQSQLTAALNSWAQAILLPRPPSVAGTTEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 1027009 - protein, 253 aa, Homo sapiens
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLWVERPMTAKKKPNFILLLKALLLSSYGLKLIKVFVLTSNFQAIRVTLNINRKLSFLAVLSGLLLESIMVYFFQSMEWDVGSDYAIFKSQDF

SEQ ID NO: 1027010 - protein, 104 aa, Homo sapiens
MTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 1027011 - protein, 190 aa, Homo sapiens
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLSFGNMTTHLCASNSLKYLFLHQIFRQLE

SEQ ID NO: 1027012 - protein, 271 aa, Homo sapiens; identical to SEQ ID NO: 1027000

SEQ ID NO: 1027013 - protein, 271 aa, Homo sapiens; identical to SEQ ID NO: 1027000

SEQ ID NO: 1027014 - protein, 100 aa, Homo sapiens
NKEFISAVAQVKAFRSLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 1027015 - protein, 100 aa, Homo sapiens; identical to SEQ ID NO: 1027014

SEQ ID NO: 1027016 - protein, 104 aa, Homo sapiens
STITYIYNGTNLKNLTNLITLWPSDIFGSCEDDPVQTLLHIYFHHQTLGQTGSFAVIGSNLDMSEANYKLMELNLEIRESLRMVQSYQLLAQAKPMGNMVSTGF

SEQ ID NO: 1027017 - protein, 325 aa, Homo sapiens
MAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCKPVAKRYTYVQVVCTEVHRGFTIPEAIPGSAYGDLRQVPEPGNESRVSTCPDDEEIKAQPNEQSGKGPRNKPPCLGTAPQPRSDESRPQKAPGWFTTLATRYGHTAKSGQWARESRRSTCSGMVMVEEGMRERNGGLSQIITVGWDD

SEQ ID NO: 1027018 - protein, 332 aa, Homo sapiens
SCHLLHGMAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCKPVAKRYTYVQVVCTEVHRGFTIPEAIPGSAYGDLSKCQSPGMNLVCRTCPDDEEIKAQPNEQSGKGPRNKPPCLGTAPQPRSDESRPQKAPGWFTTLATRYGHTAKSGQWARESRRSTCSGMVMVEEGMRERNGGLSQIITVGWDD

SEQ ID NO: 1027019 - protein, 337 aa, Homo sapiens
RDELDFLLLIATMAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCKPVAKRYTYVQVVCTEVHRGFTIPEAIPGSAYGDLSKCQSPGMNLVCRTCPDDEEIKAQPNEQSGKGPRNKPPCLGTAPQPRSHESRPQKAPGWFTTLATRYGHTAKSGQWARESRRSTCSGMVMVEEGMRERNGGLSQIITVGWDD

SEQ ID NO: 1027020 - protein, 34 aa, Homo sapiens
MSRTLASVGPIENMMTGESGSNKRLGGPRGSDSP

SEQ ID NO: 1027021 - protein, 100 aa, Homo sapiens
NYLTSPLPEEVDEPSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 1027022 - protein, 100 aa, Homo sapiens; identical to SEQ ID NO: 1027021

SEQ ID NO: 1027023 - protein, 158 aa, Homo sapiens
MRSHQDIRMCLGEKAADSGTDCCSSEGGLAFHEGTVELYAVKGGPLEVCGAQLPQAESLALTNSYGGLAVAEGLLLVCCGSLTGEMGPQAVEVVGVWENSEGHEGYNPLKFVEWPDDPQRRSPGELLRVTLLWRHRVAQNTGVLGIKVKIMLPWEPNW

SEQ ID NO: 1027024 - protein, 126 aa, Homo sapiens
MGSRQDAHGNDETHKTQQDNRGRKRPQVRLPIGTNTHPPMTGDRETEELWEHPETPQSRTPKTHKKKYKDSADTRKRNRLQETNDSHQITQNDRRTANLTDGSEDKQRQNHKRPNTTPIPSNSKST

SEQ ID NO: 1027025 - protein, 72 aa, Homo sapiens
MAALWGGGDCAPGCVPGGSTLPSPSREARTEITEHAFRQSHLTRKSRLLWPIPTRGFSRGGPLDSSFNWLHV

SEQ ID NO: 1027026 - protein, 211 aa, Homo sapiens
MMLCDTTMWHVGSRWQFGIAWGPFTHGQWLKAVAHVVMCVCCPCVHICCHAMGCACMWCSVPCCGCLCPTDVHLLCPRVWCGEGPHVDLVTAVCPHRSAPGGWLWQTVHASRGVKGMGRDQTRRGGRGGVNELSGGRMVQAGVRSAAGGEREALASRARGQGGPRGAATEPGSVPQRSGLETRPGLQLGWTCPPVAEGPRRQVRWTVTSRT

SEQ ID NO: 1027027 - protein, 82 aa, Homo sapiens
VSAPQLTPANSQSRMSTNMCGVNLGLQGQAEDRVLRGLPHQLLQVVLGAGATGPRHHLQILRVQVRLMSQDAGRDEGGPRLG

SEQ ID NO: 1027028 - protein, 500 aa, Homo sapiens
MEVDGTPRRGGCKMPLPVQVFNLQGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 1027029 - protein, 500 aa, Homo sapiens; identical to SEQ ID NO: 1027028

SEQ ID NO: 1027030 - protein, 291 aa, Homo sapiens [sequence omitted]

SEQ ID NO: 1027031 - protein, 291 aa, Homo sapiens [sequence omitted]

SEQ ID NO: 1027032 - protein, 291 aa, Homo sapiens [sequence omitted]

SEQ ID NO: 1027033 - protein, 318 aa, Homo sapiens
MCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKVGWLEGGQAHGVWGLVAVSCSLSPLQKSPPREGSQGELTPANSQSRMSTNM

SEQ ID NO: 1027034 - protein, 291 aa, Homo sapiens [sequence omitted]

SEQ ID NO: 1027035 - protein, 291 aa, Homo sapiens [sequence omitted]

SEQ ID NO: 1027036 - protein, 361 aa, Homo sapiens
MCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVPPPRTSDLQAAQCLPAAQLRGLATGCHPACVPSLGLRRQAAASCGPSWKERPAGLDPVGFCPQGADCAAPRPSGTISQTPPVPASVRCRQVGGVH

SEQ ID NO: 1027037 - protein, 158 aa, Homo sapiens
SEVPESMEVDGTPRRGGCKMPLPVQVFNLQGAVEPMQIDVDPQEDPQNAPDVNYVVENPSLDLEQYAASYSGLMRIERLQFIADHCPTLRVEALKMALSFVQRTFNVDMYEEIHRKLSEATSPLSGSCRTHPTPSLRAAWSPQPWTRPGWRPRGRRRC

SEQ ID NO: 1027038 - protein, 291 aa, Homo sapiens [sequence omitted]

SEQ ID NO: 1027039 - protein, 317 aa, Homo sapiens
MCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKVGPAWGRGEVGPCLASCPGPDQPLPQDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 1027040 - protein, 291 aa, Homo sapiens [sequence omitted]

SEQ ID NO: 1027041 - protein, 248 aa, Homo sapiens
MCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESNVRHHVSMMLDSDDRTTCSWTCIWPPMSGPCTPRFATVPSSSKILYARDVDQRSTTFEKSLLMGKEFQRRAKAMMLRAAVLRNQIHVKSPPREGSQGELTPANSQSRMSTNM

SEQ ID NO: 1027042 - protein, 291 aa, Homo sapiens [sequence omitted]

SEQ ID NO: 1027043 - protein, 246 aa, Homo sapiens
MCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKSPPREGSQGELTPANSQSRMSTNM

SEQ ID NO: 1027044 - protein, 370 aa, Homo sapiens
MCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKVGPAWGRGEVGPCLASCPGPDQPLPQDNLLLDMYLAPHVRTLYTQIRNRALIQYFSPYVSADMHRMAAAFNTTVAALEDELTQLILEGLISARVDSHSKVAVGCVGGGGSWGLSLGPAELVACTKILYARDVDQRSTTFEKSLLMGKEFQRRAKAMMLRAAVLRNQIHVKVGWLEGGQAHGVWGLVAVSCSLSPLQKSPPREGSQGELTPANSQSRMSTNM

SEQ ID NO: 1027045 - protein, 158 aa, Homo sapiens; identical to SEQ ID NO: 1027037

SEQ ID NO: 1027046 - protein, 500 aa, Homo sapiens; identical to SEQ ID NO: 1027028

SEQ ID NO: 1027047 - protein, 500 aa, Homo sapiens; identical to SEQ ID NO: 1027028

SEQ ID NO: 1027048 - protein, 141 aa, Homo sapiens
SPSPASPTPCSLLLSPPDPSRPHRHRDFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 1027049 - protein, 270 aa, Homo sapiens
GAGSGNCGGGVGISSRDYCRRFCQVVEDYAGRWQVPLPQLQVLQTALCCFTTASASFPDECEHVQYVLSSLAVSFFELLLFFGRDEFYEEPLKDILGSFQECQNHLRRYGNVNLELVTRIIRDGGPWEDPVLQAVLKAQPASQEIVNKYLSSENPLFFELRARYLIACERIPEAMALIKSCINHPEISKDLYFHQALFTCLFMSPVEDQLFREVLFETIFAYYHFNPTKKKPKKKSSPLLLLNSFYSNAKDLRITLSGCVFFWHHNLRSC

SEQ ID NO: 1027050 - protein, 320 aa, Homo sapiens
GAGSGNCGGGVGISSRDYCRRFCQVVEDYAGRWQVPLPQLQVLQTALCCFTTASASFPDECEHVQYVLSSLAVSFFELLLFFGRDEFYEEPLKDILGSFQECQNHLRRYGNVNLELVTRIIRDGGPWEDPVLQAVLKAQPASQEIVNKYLSSENPLFFELRARYLIACERIPEAMALIKSCINHPEISKDLYFHQALFTCLFMSPVEDQLFREHLLKTDCKSGIDIICNAEKEGKTMLALQLCESFLIPQLQNGDMYCIWELIFIWSKLQLKSNPSKQVFVDQCYQLLRTATNVRVIFPFMKIIKDEVNRIYLSLKFKIE

SEQ ID NO: 1027051 - protein, 50 aa, Homo sapiens
MLGSLIQEGMGGRLTPNSAKAKKFLPLLVFWAFDLYTRGLSENQDEVEPR

SEQ ID NO: 1027052 - protein, 236 aa, Homo sapiens
MAEAEESPGDPGTASPRPLFAGLSDISISQDIPVEGEITIPMRSRIREFDSSTLNESVRNTIMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTALLADSQPPNRRALAVYPVFLFYFVISWMILTFTPQ

SEQ ID NO: 1027053 - protein, 236 aa, Homo sapiens; identical to SEQ ID NO: 1027052

SEQ ID NO: 1027054 - protein, 236 aa, Homo sapiens; identical to SEQ ID NO: 1027052

SEQ ID NO: 1027055 - protein, 236 aa, Homo sapiens; identical to SEQ ID NO: 1027052

SEQ ID NO: 1027056 - protein, 236 aa, Homo sapiens; identical to SEQ ID NO: 1027052

SEQ ID NO: 1027057 - protein, 236 aa, Homo sapiens; identical to SEQ ID NO: 1027052

SEQ ID NO: 1027058 - protein, 226 aa, Homo sapiens
MAEAEESPGDPGTASPRPLFAGLSDISISQDIPVEGEITIPMRSRIREFDSSTLNESVRNTIMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVGPQVERNCTPEAILKELHLRSIMCTWSWT

SEQ ID NO: 1027059 - protein, 236 aa, Homo sapiens
MAEAEESPGDPGTASPRPLFAGLSDISISQDIPVEGEITIPMRSRIREFDSSTLNESVRNTIMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMILTFTPQ

SEQ ID NO: 1027060 - protein, 236 aa, Homo sapiens; identical to SEQ ID NO: 1027052

SEQ ID NO: 1027061 - protein, 236 aa, Homo sapiens; identical to SEQ ID NO: 1027052

SEQ ID NO: 1027062 - protein, 236 aa, Homo sapiens; identical to SEQ ID NO: 1027052

SEQ ID NO: 1027063 - protein, 236 aa, Homo sapiens; identical to SEQ ID NO: 1027052

SEQ ID NO: 1027064 - protein, 236 aa, Homo sapiens; identical to SEQ ID NO: 1027052

SEQ ID NO: 1027065 - protein, 77 aa, Homo sapiens
EIDNARELQEQRDSLNSRNYRKYKFGTIDLEGQLSDLEQRLEKSQNEQEAFRNNLKTLLEILDGKIFELTELRDNLA

SEQ ID NO: 1027066 - protein, 92 aa, Homo sapiens
EIDNARELQEQRDSLNSRNYRKYKFGTIDLEGQLSDLEQRLEKSQNEQEAFRNNLKTLLEILDGKIFELTELRDNLAPPPPHTQKPISVPIN

SEQ ID NO: 1027067 - protein, 93 aa, Homo sapiens
EIDNAIELQEQRDSLNSRNYRKYKFGTIDLEGQLSDLEQRLEKSQNEQEAFRNNLKTLLEILDGKIFELTELRDNLADATRMLLRKVKSLCPF

SEQ ID NO: 1027068 - protein, 214 aa, Homo sapiens
SYVVHTWSGVVQAGVFGRAWEHKSLFHHVSRTSHSGPGLVAKMVKPKYKGRSTINPSKASTNPDRVQGAGGQNMRDRATIRRLNMYRQKERRNSRGKIIKPLQYQSTVASGTVARVEPNIKWFGNTRVIKQSSLQKFQEEMDTVMKDPYNSGDEDSSKSPDVSSSMIESGLSNLKVHILDTEESPRTSSLGLKSQRTTTITYLHRDMQSLIDKC

SEQ ID NO: 1027069 - protein, 240 aa, Homo sapiens
SYVVHTWSGVVQAGVFGRAWEHKSLFHHVSRTSHSGPGLVAKMVKPKYKGRSTINPSKASTNPDRVQGAGGQNMRDRATIRRLNMYRQKERRNSRGKIIKPLQYQSTVASGTVARVEPNIKWFGNTRVHLKPVHPSPTNFQAAQHGITSLMKASHHTSLLHASQHQRSPTVSFSTHSTSGPSLTLQTLPHSLQLPDHLSPHNLTNSWTPYTLHTTHILTPTPSIIRTHCILTSSSLLATH

SEQ ID NO: 1027070 - protein, 131 aa, Homo sapiens
EAGQPSPGCSCTHMWPLLTMHITQLNRECLLHLFSFLDKDSRKSLARTCSQLHDVFEDPALWSLLHFRSLTELQKDNFLLGPALRSLSICWHSSRVQVCSIEDWLKSAFQRSICSRHESLVNDFLLRVCDR

SEQ ID NO: 1027071 - protein, 229 aa, Homo sapiens
NSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 1027072 - protein, 256 aa, Homo sapiens
PFHSIPFNSIPCHPIRVDSIPFHSISIPFLSIPFHSIPLWLIPFHSTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 1027073 - protein, 256 aa, Homo sapiens; identical to SEQ ID NO: 1027072

SEQ ID NO: 1027074 - protein, 70 aa, Homo sapiens
MAKMGDSRGQEIETILANKVKPTVCTKKKYKKLAGRGGGHLESQLLRRLRQENGVNPGGGASEPRTATAP

SEQ ID NO: 1027075 - protein, 119 aa, Homo sapiens
NSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVSVEF

SEQ ID NO: 1027076 - protein, 274 aa, Homo sapiens
EAGQPSPGCSCTHMWPLLTMHITQLNRECLLHLFSFLDKDSRKSLARTCSQLHDVFEDPALWSLLHFRSLTELQKDNFLLGPALRSLSICWHSSRVQVCSIEDWLKSAFQRSICSRHESLVNDFLLRVCDRVRGLNDTVAPGTYRLSAVRSPRRREAPAPSSGTPIAVGPKSPRWGGPDHSEFADLRSGVTGARAAARRGLGSLRAERPSETPPAPGVSWGPPPPGAPVVISVKQEEGKQGRTGRRSHRAAPPCGFARTRVCPPTFPGADAFPQ

SEQ ID NO: 1027077 - protein, 256 aa, Homo sapiens; identical to SEQ ID NO: 1027072

SEQ ID NO: 1027078 - protein, 119 aa, Homo sapiens; identical to SEQ ID NO: 1027075

SEQ ID NO: 1027079 - protein, 256 aa, Homo sapiens; identical to SEQ ID NO: 1027072

SEQ ID NO: 1027080 - protein, 119 aa, Homo sapiens; identical to SEQ ID NO: 1027075

SEQ ID NO: 1027081 - protein, 99 aa, Homo sapiens
AAFLSAERGGKMAVQISKKRKFVADGIFKAELNEFLTRELAEDGYSGVEVRVTPTRTEIIILATRTQNVLGEKGRRIRELTAVVQKRFGFPEGQCRALC

SEQ ID NO: 1027082 - protein, 99 aa, Homo sapiens; identical to SEQ ID NO: 1027081

SEQ ID NO: 1027083 - protein, 101 aa, Homo sapiens
TTKYQQAVRMLVQYTGLRFNENDMGRGYNYKAELNEFLTRELAEDGYSGVEVRVTPTRTEIIILATRTQNVLGEKGRRIRELTAVVQKRFGFPEGQCRALC

SEQ ID NO: 1027084 - protein, 99 aa, Homo sapiens; identical to SEQ ID NO: 1027081

SEQ ID NO: 1027085 - protein, 99 aa, Homo sapiens; identical to SEQ ID NO: 1027081

SEQ ID NO: 1027086 - protein, 99 aa, Homo sapiens; identical to SEQ ID NO: 1027081

SEQ ID NO: 1027087 - protein, 104 aa, Homo sapiens
IVVPPRGLGYRLIHGRRAVQISKKRKFVADGIFKAELNEFLTRELAEDGYSGVEVRVTPTRTEIIILATRTQNVLGEKGRRIRELTAVVQKRFGFPEGQCRALC

SEQ ID NO: 1027088 - protein, 99 aa, Homo sapiens; identical to SEQ ID NO: 1027081

SEQ ID NO: 1027089 - protein, 106 aa, Homo sapiens
TPARTTRQVEGSVVNLAQRAVQISKKRKFVADGIFKAELNEFLTRELAEDGYSGVEVRVTPTRTEIIILATRTQNVLGEKGRRIRELTAVVQKRFGFPEGQCRALC

SEQ ID NO: 1027090 - protein, 101 aa, Homo sapiens
AAFLSAERGGKMAVQISKKRKFVADGIFKAELNEFLTRELAEDGYSGVEVRVTPTRTEIIILATRTQNVLGEKGRRIRELTAVVQKRFGFPENNKDGKNGT

SEQ ID NO: 1027091 - protein, 1029 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRSHSTPSIPVLTAGQSGLYSPQYISYIPQIHMGPAVQATQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQG

SEQ ID NO: 1027092 - protein, 504 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPHRGQGQGPAGVGGSCSAPARPHPVLPSHPLIYSPAGDGRSFIFYYL

SEQ ID NO: 1027093 - protein, 1180 aa, Homo sapiens [sequence omitted]

SEQ ID NO: 1027094 - protein, 1159 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 1027095 - protein, 1135 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQSM

SEQ ID NO: 1027096 - protein, 1180 aa, Homo sapiens [sequence omitted]

SEQ ID NO: 1027097 - protein, 1061 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYQPRPPLSLPSLYSPSGRCHHVEASAATTALPAPAAAPHATGR

SEQ ID NO: 1027098 - protein, 869 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYLRTAWILFLPGSIKGEPKGI

SEQ ID NO: 1027099 - protein, 1149 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQVQSHPSQQLPFHPPGN

SEQ ID NO: 1027100 - protein, 105 aa, Homo sapiens
MVVVCGCCLRVPLEKDNSEEFRQRELRAAQLAREIESSPQYRLRIAMENDDGRTEEEKHSAVQRQGSGRESPSLASRLTVANSQDYLGLLGISWGLGPELMSAVV

SEQ ID NO: 1027101 - protein, 1179 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIQFNLIPPSSSPSTPRGTEDCPGRDLRPP

SEQ ID NO: 1027102 - protein, 616 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDSPWSSE

SEQ ID NO: 1027103 - protein, 1180 aa, Homo sapiens [sequence omitted]

SEQ ID NO: 1027104 - protein, 1060 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSLKKSPAAGCAPQRPGQSRPPH

SEQ ID NO: 1027105 - protein, 1077 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPSRASFPQAKPACCMISMRHTMAQCRKCTTTHKKKKGG

SEQ ID NO: 1027106 - protein, 434 aa, Homo sapiens
YTGLIERDLWDRVSSHSLPLLGFSRIQLSSLVGQNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 1027107 - protein, 466 aa, Homo sapiens
GASWGTTEGWRTISVIRFLNKQDLARGESPGWGNLKIGGLLSENLARYTNSVEDATPGARERTQRVTRGQCTSREEFLEDQHGQEMGVTTGYPHFTCAGDTENIRRVSNDGRDIIQRMHLRQYERLQTSEQRGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 1027108 - protein, 511 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGEL

SEQ ID NO: 1027109 - protein, 1051 aa, Homo sapiens
MGWRPGRDAPHFPPAARPPPLPPRGASSRRGFLSPPPTPRGSPRPPTAGPGCPIPLASRALQRGPSPGPLSPSLLSNSPSGRCHHVEASAATTALPAPAAAPHATCRGPSAPRGHSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRLLENFCSTSSCSGPDVSPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQVPAMGGAEWSWCRNGWPEEGIELGVISEWRGLGASELLACVALNLPLPSSIRRGRPHTWAVDSHSRICTTQGP

SEQ ID NO: 1027110 - protein, 1075 aa, Homo sapiens [sequence omitted]

SEQ ID NO: 1027111 - protein, 1141 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQLPFHPPGN

SEQ ID NO: 1027112 - protein, 1029 aa, Homo sapiens; identical to SEQ ID NO: 1027091

SEQ ID NO: 1027113 - protein, 1029 aa, Homo sapiens; identical to SEQ ID NO: 1027091

SEQ ID NO: 1027114 - protein, 761 aa, Homo sapiens
MENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 1027115 - protein, 484 aa, Homo sapiens
MGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 1027116 - protein, 752 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISVPFCRAAYPPSPLCHCSPVLPTPCHTAPCPPAAAGYHAYWKPAAVPACGPQSCPASGGAGPTLGQWTATAESVPPRGPDRHAALSATGTFCPVPSEQLPPASRCVCHPPPAAAPRLHQHGPCYPGPCPNWNHSSPAPSPWGSPPAPGDAAAPTPESWGAPPRRGAPEWGACTLSFHTLTLPLHRTPPR

SEQ ID NO: 1027117 - protein, 636 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISVPFCRAAYPPSPLCHCSPVLPTHATQSMPPARAGTRYGGQRSPAWGPVCPAQGGGPTWEWSQDLVPRPKGRL

SEQ ID NO: 1027118 - protein, 271 aa, Homo sapiens
RDAPHFLDGMAAGKRRSSFPRWDGGRAEMLLTFLQPRDPLPFRLAALPRSAVFSLHPRHRGAPPARPRRAPAARSPSLPALSSGAPAPAPSLPPFSLIPLPDAAIMLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVVSWYLTPGLFKERNASTFWRHSSYFSHSARAPLVM

SEQ ID NO: 1027119 - protein, 176 aa, Homo sapiens
GPGRAGWGLGMQPPVPGPLGLLDPAEGLSRRKKTSLWFVGSLLLVSVLIVTVGLAATTRTENVTVGGYYPGIILGFGSFLGIIGINLVENRRQMLVAAIVFISFGVVAAFCCAIVDGVFAAQHIEPRPLTTGRCQFYSSGVGYLYDVYQTEVSRSTEIHVGFAQLTPPTPRGFPCT

SEQ ID NO: 1027120 - protein, 172 aa, Homo sapiens
GPGRAGWGLGMQPPVPGPLGLLDPAEGLSRRKKTSLWFVGSLLLVSVLIVTVGLAATTRTENVTVGGYYPGIILGFGSFLGIIGINLVENRRQMTKRRGKDIKPGGSPRFTWQQCRVKSRHCLSMMFVAVCAATAIRFSWKSVLLMHCFGDYNFKNKNWLILSVRGGSLQIK

SEQ ID NO: 1027121 - protein, 162 aa, Homo sapiens
PPLPTDTHWEVRPARRTCVGARAVLGLGTVVGRSMLAALSQIFEKTGQVMLQRCLPNASRRTCCSVVEVLELGFGSFLGIIGINLVENRRQMLVAAIVFISFGVVAAFCCAIVDGVFAAQHIEPRPLTTGRCQFYSSGVGYLYDVYQTEVSEMRGVMTRGRP

SEQ ID NO: 1027122 - protein, 153 aa, Homo sapiens
ALGLTYLSLLLIPAAGASSWPPHSTPSHGSPSPVKHARDKWTTEAETVLCVWPGRLTLSPLTAFSDAAFSHCAQPLALRDLAVVYTLGPASFLVSLASCLALGSGLTACRARRRRLRTAALRPPRPPDPNPDPDPHGCASPADPGSPAAAAQA

SEQ ID NO: 1027123 - protein, 185 aa, Homo sapiens
IDGHRLARLEAEGARRLTLLRSLSLQDNELAALAPGLLGRLPALDALHLRGNPWGCGCALRPLCAWLRRHPLPASEAETVLCVWPGRLTLSPLTAFSDAAFSHCAQPLALRDLAVVYTLGPASFLVSLASCLALGSGLTACRARRRRLRTAALRPPRPPDPNPDPDPHGCASPADPGSPAAAAQA

SEQ ID NO: 1027124 - protein, 185 aa, Homo sapiens; identical to SEQ ID NO: 1027123

SEQ ID NO: 1027125 - protein, 104 aa, Homo sapiens
MSASRCGVVEEVVRESSPCPAVSVANSQYVPHRVEQYAMRAFADALEVIPMALSENSGMISIQTMTEVRARQVKEMNPALGIDCMHKGTNDMKQQHVIETLIAE

SEQ ID NO: 1027126 - protein, 119 aa, Homo sapiens
TVGSTPASLAVSAKDPYKQPGPQGGPNPSQAGQQQGQQKQKRHRTRFTPAQLNELERSFAKTHYPDIFMREELALRIGLTESRVQAACAFLYRVISFSTRKLVPIAIPQWTRKARLRPV

SEQ ID NO: 1027127 - protein, 74 aa, Homo sapiens
SVLRAIMSVLTPLLLRGLTGSAGGSQCRRQDPFVAAGGKLGIMELAVGLTSCFVTFLLPAGWILSHLETYRRPE

SEQ ID NO: 1027128 - protein, 70 aa, Homo sapiens
DLCPLNQHLSQQLFLDKARFKHHWENLEQIKPMFFNTWKERCVCLVLFFAETQTLLVQAPARGAGGVKAE

SEQ ID NO: 1027129 - protein, 70 aa, Homo sapiens; identical to SEQ ID NO: 1027128

SEQ ID NO: 1027130 - protein, 299 aa, Homo sapiens
SSRSRLGLNSAEANFATDGRGGGGSRNATRSCEQLCDLQLDVPGAACGGWQRRGRLRVGRADCARPLRPAHLVGRSMLPDWLRASASGASVWGCAGVHGLQCGAGLMRRAGVLRPRCGGWDSTGISRAGPGAARGGAAMPDENIFLFVPNLIGYARIVFAIISFYFMPCCPLTGSSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLVPFL

SEQ ID NO: 1027131 - protein, 254 aa, Homo sapiens
SSRSRLGLNSAEANFATDGRGGGGSRNATRSCEQLCDLQLDVPGAACGGWQRRGRLRVGRADCARPLRPAHLVGRSMLPDWLRASASGASVWGCAGVHGLQVVLADAPGRRAEAALRGLGQHWHLQSRARGSKGRRRDAMTKISSCSCPTSSGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLVPFL

SEQ ID NO: 1027132 - protein, 271 aa, Homo sapiens
SSRSRLGLNSAEANFATDGRGGGGSRNATRSCEQLCDLQLDVPGAACGGWQRRGRLRVGRADCARPLRPAHLVGRSMLPDWLRASASGASVWGCAGVHGLQCGAGLMRRAGVLRPRCGGWDSTGISRAGPGAARGGAAMPDENIFLFVPNLIGGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLVPFL

SEQ ID NO: 1027133 - protein, 280 aa, Homo sapiens
AALACRAQPHVAVSAAPLGGPGCFPFDQPGKALGGRCTGRRGGHQSCPGPSEDRLARTYLCQPVRMMPCSESVGPLPATCSHCTWFLRWCSTGGTAWLGPVAPLKALAAHSCGKPHRRYFCMRRTLPCTSRSPCSPRAPAPPAAAPRTLRAGPQAGLGACRPTPGVSRWGAGPSRRWPPPACVTGTTSPCCSALAVATGARPPPLRGNRPHHTRCAAAGRLGVAPGPGQSWRPPAPGTLPRGGSGCRGRSPPPAGGRRPCASAQTPCVQMSAPRESPPAH

SEQ ID NO: 1027134 - protein, 280 aa, Homo sapiens; identical to SEQ ID NO: 1027133

SEQ ID NO: 1027135 - protein, 280 aa, Homo sapiens; identical to SEQ ID NO: 1027133

SEQ ID NO: 1027136 - protein, 280 aa, Homo sapiens; identical to SEQ ID NO: 1027133

SEQ ID NO: 1027137 - protein, 215 aa, Homo sapiens
MMPCSESVGPLPATCSHCTWFLRWCSTGGTAWLGPVAPLKALAAHSCGKPHRRYFCMRRTLPCTSRSPCSPRAPAPPAAAPRTLRAGPQAGLGACRPTPGVSRWGAGPSRRWPPPACVTGTTSPCCSALAVATGARPPPLRGNRPHHTRCAAAGRLGVAPGPGQSWRPPAPGTLPRGGSGCRGRSPPPAGGRRPCASAQTPCVQMSAPRESPPAH

SEQ ID NO: 1027138 - protein, 280 aa, Homo sapiens; identical to SEQ ID NO: 1027133

SEQ ID NO: 1027139 - protein, 119 aa, Homo sapiens
CPSPFVCPSPFVCPSPFVCPSPFVCPSPFVCPSPFVCPSPFVCPSPFVCPSPFVCPSPFVCPSPFVCPSPFVGRPRRENCLNPGGGGCSELRLCHCTPAWATRAKLRLKKKNVVAFSGS

SEQ ID NO: 1027140 - protein, 134 aa, Homo sapiens
VSIPLRVSIPLRVSIPLRVSIPLRVSIPLRVSIPLRVSIPLRVSIPLRVSIPLRVSIPLRVSIPLRVSIPLRVHTQEPGEWLELLQEPGSLYILRGSARYDFSHEILRDEESIFGGTAGYPGTDAIYRDLPLPP

SEQ ID NO: 1027141 - protein, 92 aa, Homo sapiens
CPSPFVCPSPFVCPSPFVCPSPFVCPSPFVCPSPFVCPSPFVCPSPFVCPSPFVCPSPFVCPSPFVCPSPFVNKTRIRSQIQESLSVFQFMT

SEQ ID NO: 1027142 - protein, 103 aa, Homo sapiens
CPSPFVCPSPFVCPSPFVCPSPFVCPSPFVCPSPFVCPSPFVCPSPFVCPSPFVCPSPFVCPSPFVCPSPFGRTREAGTKHRRLCPEGPMASGEVHGFGRGTI

SEQ ID NO: 1027143 - protein, 110 aa, Homo sapiens
CPSPFVCPSPFVCPSPFVCPSPFVCPSPFVCPSPFVCPSPFVCPSPFVCPSPFVCPSPFVCPSPFVCPSPFELLIYERVSVVCRGVERLKCHWRARHSAICLEPQNFERL

SEQ ID NO: 1027144 - protein, 109 aa, Homo sapiens
CPSPFVCPSPFVCPSPFVCPSPFVCPSPFVCPSPFVCPSPFVCPSPFVCPSPFVVLGYLASHMQKTETEPLLTPQTKINSRWIKELDVKSKTTKTLEDNVGNTILTKGD

SEQ ID NO: 1027145 - protein, 81 aa, Homo sapiens
CPSPFVCPSPFVCPSPFVCPSPFVCPSPFVCPSPFVCPSPFVCPSPFVCPSPFVCPSPFVCPSPFVCPSPFVLANTMGKGH

SEQ ID NO: 1027146 - protein, 81 aa, Homo sapiens
CPSPFVCPSPFVCPSPFVCPSPFVCPSPFVCPSPFVCPSPFVCPSPFVCPSPFVCPSPFVCPSPFVCPSPFVCPSPFVCPS

SEQ ID NO: 1027147 - protein, 88 aa, Homo sapiens
VSIPLRVSIPLRVSIPLRVSIPLRVSIPLRVSIPLRVSIPLRVSIPLRVSIPLRVSIPLRVSIPLRVSIPLRVSSEQLPTKGDDIDPV

SEQ ID NO: 1027148 - protein, 146 aa, Homo sapiens
IRIGDLKPTGEIPKQVKVKKLKNLKTLDSKPGVYTSYKPYLNRDEEIIKQLQKGVQQKRPSEAQSVILRRYFLELTQSFIIPLERYVASLMPLQKSISPWKSPPQLRQFLPEEFMKTLEKTGPQLTSRIKRRLDWTLPAFPKVSKF

SEQ ID NO: 1027149 - protein, 146 aa, Homo sapiens; identical to SEQ ID NO: 1027148

SEQ ID NO: 1027150 - protein, 110 aa, Homo sapiens
MTPNRGPLSPPNDLRPSHVISLPLHNAPHTRPTNQHTNHIPMMARCNTRKHIPRPPHTTCPKRPSIRDNPIYYLRSFFLRRIFLSLLPLQPSPYPPIRRALAQQAYPVNP

SEQ ID NO: 1027151 - protein, 134 aa, Homo sapiens
MTPNRGPLSPPNDLRPSHVISLPLHNAPHTRPTNQHTNHIPMMARCNTRKHIPRPPHTTCPKRPSIRDNPIYYLRSFFLRRIFLSLLPLQPSPYPPIRRALAPNRHHPAKSPRSPTPKHIRITRIRSINHLSSP

SEQ ID NO: 1027152 - protein, 150 aa, Homo sapiens
MTPNRGPLSPPNDLRPSHVISLPLHNAPHTRPTNQHTNHIPMMARCNTRKHIPRPPHTTCPKRPSIRDNPIYYLRSFFLRRIFLSLLPLQPSPYPPIRRALAPQNKGQFQTPGFKNIPPFKEKSFPQVPFKKQPIFPGNITSRPISKGKG

SEQ ID NO: 1027153 - protein, 90 aa, Homo sapiens
MPIPEDLSTTSGGQQSSKSDRVVGKWVTSGLCACETFISLYFSKTVMKGCKSFYPLCSLNWHIKEIWHKDQQDGGPLVCGRMDTHRPAWP

SEQ ID NO: 1027154 - protein, 118 aa, Homo sapiens
LVVLAPPGLVVVFVCFFYGFSRGDILFVRAWPVHIGRWRGGSAALVSVSCVCVVLVAPAGGAVIFRCRWGCGAAPLCVSPAPASVVVGCFPSGVGSRRLLLLFSPLPLCVFYAAATVS

SEQ ID NO: 1027155 - protein, 519 aa, Homo sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 1027156 - protein, 582 aa, Homo sapiens
MRNLLEEEEDTEGPVARHQDPSQVAGSEGNSEQPLGPQSLDLCGKGSSHLALARPRLVDNLRTMDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 1027157 - protein, 595 aa, Homo sapiens
EFRRRGRIPVWAGRSAAARRASLAGQREPRLRGCSSPPRISLGPKARRTNPHNLRTMDADEGQDMSQVSGKESPPVSDTPDEGDEPMPIPEDLSTTSGGQQSSKSDRVVVTYGADDFRDFHAIIPKSFSPSNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 1027158 - protein, 221 aa, Homo sapiens
MRNLLEEEEDTEGPVARHQDPSQVAGSEGNSEQPLGPQSLDLCGKGSSHLALARPRLVDNLRTMDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGKAWLSFSFSGLEKVHGV

SEQ ID NO: 1027159 - protein, 495 aa, Homo sapiens
MRNLLEEEEDTEGPVARHQDPSQVAGSEGNSEQPLGPQSLDLCGKGSSHLALARPRLVDNLRTMDADEGQDMSQVSGKESPPVSDTPDEGDEPMPIPEDLSTTSGGQQSSKSDRVVENGPSSAISAGPHSPRRATCSGTSSCIPGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 1027160 - protein, 516 aa, Homo sapiens [sequence omitted]

SEQ ID NO: 1027161 - protein, 516 aa, Homo sapiens [sequence omitted]

SEQ ID NO: 1027162 - protein, 505 aa, Homo sapiens
MPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMCQSSRQPRPAGVNKHLWGCPASSRTSHEWLLWPKAVLQAKQTALGWNSPT

SEQ ID NO: 1027163 - protein, 505 aa, Homo sapiens; identical to SEQ ID NO: 1027162

SEQ ID NO: 1027164 - protein, 505 aa, Homo sapiens; identical to SEQ ID NO: 1027162

SEQ ID NO: 1027165 - protein, 417 aa, Homo sapiens
MTIDPTPGCRWKAPVRLQAGFPSCPAGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMCQSSRQPRPAGVNKHLWGCPASSRTSHEWLLWPKAVLQAKQTALGWNSPT

SEQ ID NO: 1027166 - protein, 523 aa, Homo sapiens
PAEQGQTSPILNPHFVGEKLRHGEGSGFAQATWPVHGRWVSESRPARALETTWLVPAGTALSSHSPPLPATSSFSCYLLAVFSPGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMCQSSRQPRPAGVNKHLWGCPASSRTSHEWLLWPKAVLQAKQTALGWNSPT

SEQ ID NO: 1027167 - protein, 100 aa, Homo sapiens
PAVREHTALGGGLVTLAKLDLCSPGLLLDATNNFSYVFYMSSFFLISAALFMGGSFYALQKKEQGKQAVAADALERDLFLEAKDGPGKQRSPEIMYVTSV

SEQ ID NO: 1027168 - protein, 522 aa, Homo sapiens
MPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGGKAPVRLQAGFPSCPAGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMCQSSRQPRPAGVNKHLWGCPASSRTSHEWLLWPKAVLQAKQTALGWNSPT

SEQ ID NO: 1027169 - protein, 505 aa, Homo sapiens; identical to SEQ ID NO: 1027162

SEQ ID NO: 1027170 - protein, 505 aa, Homo sapiens; identical to SEQ ID NO: 1027162

SEQ ID NO: 1027171 - protein, 505 aa, Homo sapiens; identical to SEQ ID NO: 1027162

SEQ ID NO: 1027172 - protein, 264 aa, Homo sapiens
KGLRSSSVCEQILKPELHPGARAMRRERCGCPPPASPPWRCCGCSSVFAAENMDAFDLLCPQTMELGGPVPMAAWAWEYCCTAAGYLAAAWPRPWSCCPELLPLPGPWDAWLRCAAGACCCLGDELEMILCPASTATWRRQLHILPAVLSLWLTDAFLAGGLATSSLQCITWGKVVSLYAVAAGLAVDCVRQAQPAMVHALVDCLGEFVRKTLATWLRRRGGWTDVLKCVVSTDPGLRSHWLVAALCSFGRFLKAAFFVLLPER

SEQ ID NO: 1027173 - protein, 123 aa, Homo sapiens
KGLRSSSVCEQILKPELHPGARPCGGRGITWGKVVSLYAVAAGLAVDCVRQAQPAMVHALVDCLGEFVRKTLATWLRRRGGWTDVLKCVVSTDPGLRSHWLVAALCSFGRFLKAAFFVLLPER

SEQ ID NO: 1027174 - protein, 123 aa, Homo sapiens; identical to SEQ ID NO: 1027173

SEQ ID NO: 1027175 - protein, 123 aa, Homo sapiens; identical to SEQ ID NO: 1027173

SEQ ID NO: 1027176 - protein, 264 aa, Homo sapiens; identical to SEQ ID NO: 1027172

SEQ ID NO: 1027177 - protein, 123 aa, Homo sapiens; identical to SEQ ID NO: 1027173

SEQ ID NO: 1027178 - protein, 107 aa, Homo sapiens
MGLRLREWTCNGKFWWEPRRTEGLNDPPEQPGFSGEFLKFGFNPAQEFSWGIVLSEGELNTPHLGLLNTSGKSRFHSDSNNWGKIVAYKPYYLEDSSTKLYLKWQVV

SEQ ID NO: 1027179 - protein, 107 aa, Homo sapiens; identical to SEQ ID NO: 1027178

SEQ ID NO: 1027180 - protein, 107 aa, Homo sapiens; identical to SEQ ID NO: 1027178

SEQ ID NO: 1027181 - protein, 159 aa, Homo sapiens
PVVTRSVGGEIVLPLHIRGEVLTTCFSIARLPVGATPFHSGKLTISHPQASGAASAPSASYQALAKPGDPFLPGGSQDPSDRTPPITPAQVLIRFPTQRKLVVIPQSVTPETIAEKSKVFDFELSTQDMTTLLSYNRNWRVCALLSCTSPKDYPFHEEF

SEQ ID NO: 1027182 - protein, 159 aa, Homo sapiens; identical to SEQ ID NO: 1027181

SEQ ID NO: 1027183 - protein, 294 aa, Homo sapiens
MPSSVSWGILLLAGLCCLVPVSLAEDPQGDAAQKTDTFHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFAEDVKKLYHSEAFTVNFGDTEEAKKQINDYVEKGYSRGQIRGLGPRSLTDDTVCALVNDIFFQRANGRDPLTVKDTEEEDFHVGQVTTVKVPMMKRLRHVNIQHCKKLSSWVLLMKILGNATHLLPACEGKYSTWKMNHQ

SEQ ID NO: 1027184 - protein, 193 aa, Homo sapiens
MPSSVSWGILLLAGLCCLVPVSLAEDPQGDAAQKTDTFHHDQDHPTFNKITPNLAEFAFSLYRQLAHQSNSTNIFFSPVSIATAFAMLSLGTKADTHHGVLQGLNLSLTDIPAARIHDSFQDLLLTVNQPESQLHLTTGDGLLLTDGLLVDGFLEDVERFACGRLNCPVRGWLEPAQGDAGPHREGDDSGELC

SEQ ID NO: 1027185 - protein, 266 aa, Homo sapiens
MPSSVSWGILLLAGLCCLVPVSLAEDPQGDAAQKTDTFHHDQDHPTFNKITPNLAEFAFSLYRQLAHQSNSTNIFFSPVSIATAFAMLSLGTKAVLRTLNQPDSQLQLTTGNGLFLSEGLKLVDKFAEDVKKLYHSEAFTCQLRGHRRGQETDQRLRGERVLKGKIRGLGPRSLTDDTVCALVNDIFFQRANGRDPLTVKDTEEEDFHVGQVTTVKVPMIEAFRHVNIQHCKKLSSWVLLMRYWAMHRIFFLPDEGKYSTWKMNHQ

SEQ ID NO: 1027186 - protein, 243 aa, Homo sapiens
AAAAFARTVCGLSSVTALSVCLAPALCGFLALTKRSLSSSARVSEEEELEALSVASTCQLVWDSPAAAGSIDVCVTCHSLDGKCQLKPEPSPAYYEFIGVQDCQDVLHLYRLLWASAVLNVLGLFLGIITAAVLGAFKDMVPLSQLAYGPAVPPQTLYNPAQQILAYAGFRLTPEPVPTCSSYPLPLQPCSRFPVAPSSALASSEDLQPPSPSSSGSGLPGQAPPCYAPTYFPPGEKPPPYAP

SEQ ID NO: 1027187 - protein, 103 aa, Homo sapiens
ALNIRAFHAIESLLQSDGDDFNYIIAFFLGTAACLYQCYLLVYYTGWRNVKSFLTFGLICLCNMYLYELRNLWQLFFHVTVGAFVTLQIWLRQAQGKAPDYDV

SEQ ID NO: 1027188 - protein, 70 aa, Homo sapiens
AWATLRILSGRHGWRNVKSFLTFGLICLCNMYLYELRNLWQLFFHVTVGAFVTLQIWLRQAQGKAPDYDV

SEQ ID NO: 1027189 - protein, 103 aa, Homo sapiens; identical to SEQ ID NO: 1027187

SEQ ID NO: 1027190 - protein, 103 aa, Homo sapiens; identical to SEQ ID NO: 1027187

SEQ ID NO: 1027191 - protein, 103 aa, Homo sapiens; identical to SEQ ID NO: 1027187

SEQ ID NO: 1027192 - protein, 189 aa, Homo sapiens
RPPWEPARPRPRPPPRPPRWLRFSLMMSSRDMSILSAMAGAESGIGSSPRVSTPARHFRRRVRPSGATASERLLIGRWRTAARAGRGEAGRRVRTGVRDSAGAVEGVGPRLWSFLYLPARTPALPTEGRVGRCVIRLAKVRGRRGWGGGRWRRSLRAPPSPHAPDRPGLGALGALRARRVPGSCWESLF

SEQ ID NO: 1027193 - protein, 376 aa, Homo sapiens
RPPWEPARPRPRPPPRPPRWLRFSLMMSSRDMSILSAMAGAESGIGSSPRVSTPARHFRRRVRPSGATASERLLIGRWRTAARAGRGEAGRRVRTGVRDSAGAVEGVGPRLWSFLYLPARTPALPTEGRVGRDGVSSCWPGPFEIFEDILNVRLCCHEGEDKFWDGVAYCGSWVANDENCGIFRMAFTDAALIFKVPGTDFPLCGASAPTVFHMRCVLKWFRTVWVPASMAHCGRRGMECQGGGGPTWLSLEGAILENSFLMLAPMAAGEQRPEAATGGTKGLELRFVAITIFDLLPYVKFILLNSCGKQPVKKIVGGRAKSLTTLVGAAGGGNGYVQGPGDCGVPQKRGGGLKHGRSCPAHPRARKTRTPEKNRD

SEQ ID NO: 1027194 - protein, 443 aa, Homo sapiens
IDCSTKQRENVYLAACGETLNIDFSLPFTDLSPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQVWFSEYYLLTYFLFPFSTHLLKNNLYACLNVHCISTDGILMGVILAIQNFSYR

SEQ ID NO: 1027195 - protein, 594 aa, Homo sapiens
IDCSTKQRENVYLAACGETLNIDFSLPFTDLSPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQLACLLEWGQTFVFHVVCREYELERPKSVIICQHGIDRRFCESKLSCIPGPCPTSDDLKYTMIRLAVDGTLNIVSIVEHGCATNIKMGAIRVANCNLHNQSVGEGISAAIQDFQVRQYIEQLNNCRIGLQPAVLRRAYWLEAGSANLGLITVDIALAADHHSKHEAQRHFLETHDARTKRLWFLWPDDILKNKRCRNHNLLVLAS

SEQ ID NO: 1027196 - protein, 635 aa, Homo sapiens
IDCSTKQRENVYLAACGETLNIDFSLPFTDLSPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQLACLLEWGQTFVFHVVCREYELERPKSVIICQHGIDRRFCESKLSCIPGPCPTSDDLKYTMIRLAVDGTLNIVSIVEHGCATNIKMGAIRVANCNLHNQSVGEGISAAIQDFQVRQYIEQLNNCRIGLQPAVLRRAYWLEAGSANLGLITVDIALAADHHSKHEAQRHFLETHDARTKRLWFLWPDDILKNKRCRNKCGCLGGCRFFGGTVTGLDFFKLEDLTPSSSSAFSSTSAESDMYMDTNV

SEQ ID NO: 1027197 - protein, 82 aa, Homo sapiens
TSIRSGCLLGCVDLIDCLSQKQFKEQFPDISQESDSPFVFICKNPQEMVVKVPIEGNPKIWKLDSKIHQGAKKGLMKQNKAV

SEQ ID NO: 1027198 - protein, 82 aa, Homo sapiens
ENTFEGSGRGSLRWQESLCSSLRDCDKRQEERIQERFGQADECPRAKDACQGVPCPQEQLAPEALLCSITDQAHSVTCVAVA

SEQ ID NO: 1027199 - protein, 205 aa, Homo sapiens
LKPASISVSLPFTDFPRYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 1027200 - protein, 216 aa, Homo sapiens
MQITASRTGKVYPACHFLLAVSAGARQHVCGTAQSLADRLAPGGHSVRQQVHPADEAPHPGAHHQPVPSYQLYFWYKRAPLREGQLCCSQISFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 1027201 - protein, 227 aa, Homo sapiens; identical to SEQ ID NO: 769835

SEQ ID NO: 1027202 - protein, 184 aa, Homo sapiens
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKGK

SEQ ID NO: 1027203 - protein, 205 aa, Homo sapiens
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIQIQGRARWLMPVIPALQEAEAGGSPVEVQEFETSLANMVKARLY

SEQ ID NO: 1027204 - protein, 373 aa, Homo sapiens
FISAGDQLTLRMQTAESDGAMYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVRRDAHARLVVPRQSGPPRNVIPALELVEPIKKYEVPGKSDVYWEVCEFLVNGGDRSRDEINERVLSKEILDACDIDVVE

SEQ ID NO: 1027205 - protein, 278 aa, Homo sapiens
MLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVRRDAHARLVVPRQSGPPKNVIPALELVEPIKKYEVPGKSDVYWEVVNCLVNGGDRSRDEINERVLSKEILDACDIDVVE

SEQ ID NO: 1027206 - protein, 173 aa, Homo sapiens
MQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFGVPKARSECSKPRAAGL

SEQ ID NO: 1027207 - protein, 121 aa, Homo sapiens
FPREWLCDRHLREKMFSSVAHLARANPFNTPHLQLVHDGLGDLRSSSPGPTGQPRRPRNLAAAAVEEYSCEFGSAKYYALCGFGGVLSCGLTHTCCGSPMRISGDKLPDIRERSGPPPRER

SEQ ID NO: 1027208 - protein, 117 aa, Homo sapiens
FPREWLCDRHLREKMFSSVAHLARANPFNTPHLQLVHDGLGDLRSSSPGPTGQPRRPRNLAAAAVEEYSCEFGSAKYYALCGFGGVLSCGLTHTCCGSPGFSEMPYAGGPPKVQGHI

SEQ ID NO: 1027209 - protein, 220 aa, Homo sapiens
QSDHLKKRYPHLQAHIKDRSCTGQLYLLQHLPLPGKMKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTHNVGAGGCAKAGLLGILGISICADIHV

SEQ ID NO: 1027210 - protein, 109 aa, Homo sapiens
QSDHLKKRYPHLQAHIKDRSCTGQLYLLQHLPLPGKMKILVAFLVVLTIFGIQSHGYEVFNIISPSNNGGNVQETVTIDNEKNTAIINIHAGSCSSTTIFDQRLPEGCT

SEQ ID NO: 1027211 - protein, 197 aa, Homo sapiens
QSDHLKKRYPHLQAHIKDRSCTGQLYLLQHLPLPGKMKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTREYQ

SEQ ID NO: 1027212 - protein, 815 aa, Homo sapiens
MSKQFQAFGDLFDEAIKLGLTAIQTQNPGFYYQQAAYYAQERKQLAKTLCNHEASVMYPNPDPLETQTGVLDFYGQRSWRQGILSFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGPELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSFGRVRESLPVKYHLQNKTDLVQDVEISVEPSDAFMFSGLKQIRLRILPGTEQEMLYNFYPLMAGYQQLPSLNINLLRFPNFTNQLLRRFIPTSIFVKPQGRLMDDTSIAAA

SEQ ID NO: 1027213 - protein, 669 aa, Homo sapiens
MSCVSSYAGFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSLNINLLRFPNFTNQLLRRFIPTSIFVKPQGRLMDDTSIAAA

SEQ ID NO: 1027214 - protein, 739 aa, Homo sapiens
MSCVSSYAGFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSFKRRPKLPDNEVHWDSIIIQASTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSFGRVRESLPVKYHLQNKTDLVQDVEISVEPSDAFMFSGLKQIRLRILPGTEQEMLYNFYPLMAGYQQLPSLNINLLRFPNFTNQLLRRFIPTSIFVKPQGRLMDDTSIAAA

SEQ ID NO: 1027215 - protein, 717 aa, Homo sapiens
MSCVSSYAGFDLSDPEKEKVGILAIQLKERNVVHSEIIITLLSNAVAQFKKYKCPRMKSHLMVQMGEEYYYAKDYTKALKLLDYVMCDYRSEGWWTLLTSVLTTALKCSYLMAQLKDYITYSLELLGRASTLKDDQKSRIEKNLINVLMNESPDPEPDCDILAVKTAQKLWADRISLAGSNIFTIGVQDFVPFVQCKAKFHAPSFHVDVPVQFDIYLKADCPHPIRFSKLCVSFNNQEYNQFCVIEEASKANEVLENLTQGKMCLVPGKTRKLLFKFVAKTEDVGKKIEITSVDLALGNETGRCVVLNWQGGGGDAASSQEALQAARSTMIISRVPNISVHLLHEPPALTNEMYCLVVTVQSHEKTQIRDVKLTAGLKPGQDANLTQKTHVTLHGTELCDESYPALLTDIPVGDLHPGEQLEKMLYVRCGTVGSRMFLVYVSYLINTTVEEKEIVCKCHKDETVTIETVFPFDVAVKFVSTKFEHLERVYADIPFLLMTDLLSASPWALTIVSSELQLAPSMTTVDQLESQVDNVILQTGESASECFCLQCPSLGNIEGGVATGHYIISWKRTSAMENIPIITTVITLPHVIVENIPLHVNADLPSFGRVRESLPVKYHLQNKTDLVQDVEISVEPSDAFMFSGLKQIRLRILPGTEQEMLYNFYPLMAGYQQLPSLNINLLRFPNFTNQLLRRFIPTSIFVKPQGRLMDDTSIAAA

SEQ ID NO: 1027216 - protein, 149 aa, Homo sapiens
MENIPIITTVITLPHVIVENIPLHVNADLSSFSVDLPSFGRVRESLPVKYHLQNKTDLVQDVEISVEPSDAFMFSGLKQIRLRILPGTEQEMLYNFYPLMAGYQQLPSLNINLLRFPNFTNQLLRRFIPTSIFVKPQGRLMDDTSIAAA

SEQ ID NO: 1027217 - protein, 739 aa, Homo sapiens; identical to SEQ ID NO: 1027214

SEQ ID NO: 1027218 - protein, 85 aa, Homo sapiens
NCLEVIPVIEDTISLLRLITVAGKGFIFDDGGATWFFSSYGGILELRRGIQAASCVGPGKSNLPFELRRKAGDCSRVTAGPIDLI

SEQ ID NO: 1027219 - protein, 84 aa, Homo sapiens
EFGTRSHQGCQVPFRPPIPNVGLLLRRCSGKGLHLAMTGEPRGFSRVTAGFSSYDGEFRLPLVLAQASPIFHSSCEGKLGIALE

SEQ ID NO: 1027220 - protein, 84 aa, Homo sapiens; identical to SEQ ID NO: 1027219

SEQ ID NO: 1027221 - protein, 76 aa, Homo sapiens
GGQHHAARVLHLHRQPRMFRGRPQNKDRDQHGPARREAVSSWAARPEPSSNWRLILWLGTFPAWLRGVRLRNHTSG

SEQ ID NO: 1027222 - protein, 121 aa, Homo sapiens
MAVSTTPPESSTSIVSRACFGAGPKTKTGTSMDRRAGRLSQLGGAARALFQLEAYPVAGNISCLAARSETKKPYLRLRREAGFDMCALGKKRRKCDTLSFKASTSKIEELDYIAVYLVKLQ

SEQ ID NO: 1027223 - protein, 213 aa, Homo sapiens
MERVHIAVGAVILAPLDLVQGGVREVELLGTVVDGQAIGGTDVLLDKGQDIGSRERRPHDAGMLLIPVGPEHEVLALVQNEGPWVVISRHSDDGLTLEGPWAGLVHCVARDGGCRVACPIESVPATVIGQAFHGAHVFHNGDPPGAIVVDLLDVPKVDVVEEDAIGGARRGACPVVKGQGDDVLHVLRVIEGLHGRIEVALIRQVDTLENGAL

SEQ ID NO: 1027224 - protein, 89 aa, Homo sapiens
MVQLDALVIDLHVHHQGGAVPKDHGARAVSLAACAHLFRHLISPPQLVPHDGQGGGLAQLAPHGIDDLQPTPIQVAAVDGMDPGDIHLS

SEQ ID NO: 1027225 - protein, 71 aa, Homo sapiens
LDVQLFVCVPATVSGFDGHRMGGKKATFGGQKQKRLSSFRSMGTGPRLEPLPGILAFCTQHFAAPLLNHIN

SEQ ID NO: 1027226 - protein, 197 aa, Homo sapiens
MGEAGQAGRAALGGAQGPGPAPQPFCNKGQARAPGHRRAAFYDLWASDNPLDRPLVGQDEFFLEQTKKKGVKRPARLHTKPSQAPAVEVAPAGASYNPSFEDHQNLLSAATRWSCSGRRRRRSWSGSWPCHATEQPPPRRSTFQELCEGLLEESDGEGEPGRARAELRMPSLSQPRRLDTQRKTDSTGERRAQVRYK

SEQ ID NO: 1027227 - protein, 252 aa, Homo sapiens
HAYATRLMAAGGSGVGGKRSSKSDADSGFLGLRPTSVDPALRRRRRGPRNKKRGWRRLAQEPLGLEVDQFLEDVRLQERTSGSALFVLMAAQNEKISFFRWENMYFTYVIKTVLDHKGRRNPKVQKDSPLACSKENPLGGFEPFYTFAGTTIPEWFPFVPAQYDVPFDPPPRFPPKLAPNEEGFNVAGNTLKAMALIGGQDMAWALNGLGGPDAFDPLWARCLAAKGAPIGPPGLSTSKTHFSLPNNMGANT

SEQ ID NO: 1027228 - protein, 205 aa, Homo sapiens
MPSQAPAVEVAACRAGRAALGGAQGPGPAPQPFCNKGQARAPGHRRAAFYDLWASDNPLDRPLVGQDEFFLEQTKKKGVKRPARLHTKPSQAPAVEVAPAGASYNPSFEDHQNLLSAATRWSCSGRRRRRSWSGSWPCPATEQPPPRRSTFQELCEGLLEESDGEGEPGRARAELRMPSLSQPRRLDTQRKTDSTGERRAQVRYK

SEQ ID NO: 1027229 - protein, 147 aa, Homo sapiens
AVLTTLAQVGTHCRQHLEAKASPAAQAIHSVLLNQYCVAYKTPVSDRVTKCCTESLVNRRPCFSALEVDETYVPKEFNAETFTFHADICTLSEKERQIKKQTALVELVKHKPKASQEPLKAPTASSSSSCTAALQAFPQADLLYRGG

SEQ ID NO: 1027230 - protein, 142 aa, Homo sapiens
DRPHTSPQCPPISATPKPSRTPRANTTLRCTRTQLCVLHHHTASKRHSHPMLHKSLVTAAPAFQLSQPIQHRFLRRTDPSRTNLHLLSLSHPSPRHHKSTCNLPPPPLPALAEPPCKPAPKQTCSTEEGKKLVAASQAALGL

SEQ ID NO: 1027231 - protein, 292 aa, Homo sapiens
MCESACWTWPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1027232 - protein, 323 aa, Homo sapiens
ISNAIQPPPISINQITTTKMLKPCENPTHAEVKMMRSCYLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1027233 - protein, 323 aa, Homo sapiens; identical to SEQ ID NO: 1027232

SEQ ID NO: 1027234 - protein, 305 aa, Homo sapiens
ISNAIQPPPISINQITTTKMLKPCENPTHAEVKMMRSCYLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHERRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1027235 - protein, 306 aa, Homo sapiens
ISNAIQPPPISINQITTTKMLKPCENPTHAEVKMMRSCYLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKPPARPPKRRPPPPPPSPGSRRPQEPAPPHADPRPEKERQIKKQTALVELVKHKPKATKEQLKAVMDDFAAFVEKCCKADDKETCFAEEGKKLVAASQAALGL

SEQ ID NO: 1027236 - protein, 303 aa, Homo sapiens
ISNAIQPPPISINQITTTKMLKPCENPTHAEVKMMRSCYLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKKCCKADDKETCFAEEGKKLVAASQAALGL

SEQ ID NO: 1027237 - protein, 323 aa, Homo sapiens; identical to SEQ ID NO: 1027232

SEQ ID NO: 1027238 - protein, 323 aa, Homo sapiens; identical to SEQ ID NO: 1027232

SEQ ID NO: 1027239 - protein, 323 aa, Homo sapiens; identical to SEQ ID NO: 1027232

SEQ ID NO: 1027240 - protein, 102 aa, Homo sapiens
MTETHSELAIFTVIYLGEFNAETFTFHADICTLSEKERQIKKQTALVELVKHKPKATKEQLKAVMDDFAAFVEKCCKADDKETCFAEEGKKLVAASQAALGL

SEQ ID NO: 1027241 - protein, 300 aa, Homo sapiens
ISNAIQPPPISINQITTTKMLKPCENPTHAEVKMMRSCYLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKLKAPKEPPPSSHGRLPSSLRQQVLQG

SEQ ID NO: 1027242 - protein, 447 aa, Homo sapiens
MSASKIPLFKMKDLILILCLLEMSFAVPFFPQQSGTPGMASLSLETMRQLGSLQRLNTLSQYSRYGFGKSFNSLWMHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 1027243 - protein, 434 aa, Homo sapiens
YSPPFYNYIMKEKRTFVLPHICYPGMASLSLETMRQLGSLQRLNTLSQYSRYGFGKSFNSLWMHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 1027244 - protein, 441 aa, Homo sapiens
CYTNYWYTRPEDKLTRTEHNSVTLTQQSGTPGMASLSLETMRQLGSLQRLNTLSQYSRYGFGKSFNSLWMHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 1027245 - protein, 372 aa, Homo sapiens
MHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 1027246 - protein, 409 aa, Homo sapiens
MASLSLETMRQLGSLQRLNTLSQYSRYGFGKSFNSLWMHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 1027247 - protein, 409 aa, Homo sapiens; identical to SEQ ID NO: 1027246

SEQ ID NO: 1027248 - protein, 447 aa, Homo sapiens; identical to SEQ ID NO: 1027242

SEQ ID NO: 1027249 - protein, 212 aa, Homo sapiens
LSVEWVVQVERARVHSTWVVPNGGGGMYSIEYQIASEARRWEVGALSPGSHPHGLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLLTVWGCPFNELELMPFSGFGV

SEQ ID NO: 1027250 - protein, 917 aa, Homo sapiens
DSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASSEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 1027251 - protein, 441 aa, Homo sapiens
MSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASSEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 1027252 - protein, 300 aa, Homo sapiens [sequence omitted]

SEQ ID NO: 1027253 - protein, 917 aa, Homo sapiens; identical to SEQ ID NO: 1027250

SEQ ID NO: 1027254 - protein, 799 aa, Homo sapiens
DSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQVKKMKLSLTDSG

SEQ ID NO: 1027255 - protein, 928 aa, Homo sapiens
DSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 1027256 - protein, 817 aa, Homo sapiens
DSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASSEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 1027257 - protein, 942 aa, Homo sapiens
DSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASSEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLLRQVIVQAECRQAIHEPKLKRRDAHP

SEQ ID NO: 1027258 - protein, 121 aa, Homo sapiens
PRVKTKRWMPIFLLFAASTRLDVCDRKGPGELIKENLATDDVMLLDTGTRSFVWVGKDSQEEEKTEALSAKRYIETGPANRDRRTPITVVKQGFEPPSFVGWFLGWDNDYWFVDPLDRAMA

SEQ ID NO: 1027259 - protein, 1372 aa, Homo sapiens
QDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLAKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQSQTSILQGFSYSDLRKFGIVLSAVITKSWPRTADNFDDILKHLLTLADVKHVFRLCGTDEKILANVTEDAKRLIAVADSVLTKVVGDLLSGTILVGQLELIIKHKNQFLDIWQLREKSLSPQDEQCAVEEALDWRREELLLLKKEKRCVDSLLKMCGNVKHLIQVDFGVLAVRHSQDLSSKRLNDTMTVRLSTSSNSQRATHYHLSSQVQEMAGKIDLLRDSHIFQLFWREAAEPLSEPKEDQEAAELLSEPEEESERHILELQEVYDYLYQPSYRKFIKLHQDLKSGEVTLAEIDVIFKDFVNKYTDLDSELKIMCTVDHQGQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFYEASEKAVEGSG

SEQ ID NO: 1027260 - protein, 935 aa, Homo sapiens
QDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLAKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQVNNLSSWETDSGSQLCSAMTQLRAMKHPLGLSSSANSEIGKWAPSSLAKGNGAEI

SEQ ID NO: 1027261 - protein, 300 aa, Homo sapiens
GTGPGVCRAPLWGVLFPLSLLGTAWGPAHWQDRGCLGFRGSTQMPFPPSLFSPVSPTFRVNPENPGEWKCFGNVGSCQGLWSLHRSHSLSSLCQGGEEGVQHLAGNLSPQPRMTDPPSCVTKDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQVNNLSSWETDSGSQLCSAMTQLRAMKHPLGLSSSANSEIGKWAPSSLAKGNGAEI

SEQ ID NO: 1027262 - protein, 306 aa, Homo sapiens
MTVRLSTSSNSQRATHYHLSSQVQEMAGKIDLLRDSHIFQLFWREAAEPLSEPKEDQEAAELLSEPEEESERHILELQEVYDYLYQPSYRKFIKLHQDLKSGEVTLAEIDVIFKDFVNKYTDLDSELKIMCTVDHQGQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFYEASEKAVEGSG

SEQ ID NO: 1027263 - protein, 207 aa, Homo sapiens
EKGEILAPTVACVLSFCPHKCDSARNLEWLKTVNESHGSVERSSLTLATAINQRGIYVIQAPKGGQKISPDTVLHLILPESPGSHEESREYSLEEVKELFDKLMLMSGKKDRNNTEVERFSEVFCSVQRLSQAFIDLHSAGNMLFRTWIPWPTAPPSRVCPSKWTLAWTLVTELKEGGDVTELLAALCRQMEHFPDSWKRFRTQPTA

SEQ ID NO: 1027264 - protein, 108 aa, Homo sapiens
RSSVAEQEVIWNSHGNSKEAGGGEPTVLTVFFIYSGTDEKILANVTEDAKRLIAVADSVLTKVVGDLLSGTILVGQLELIIKHKNQFLDIWQLSKHRDRYALYRLLRH

SEQ ID NO: 1027265 - protein, 174 aa, Homo sapiens
EFKIHFIKMLSRISGSQESQFILIREKQPWGFDHPIQGEELGVPVVTALGNLGIEGGWGCWDGQCLQLTDSGVLVNEFQSTESFFLQTDNFDDFRRETLDQINQELIQAKKLLQDISEARCKGLQALSLRKEFICWVREALGGKISLWGCVEVWRKFSDGALCGIPKLFGNTSP

SEQ ID NO: 1027266 - protein, 317 aa, Homo sapiens
CRLTLVEIPHGRRSLVIIAISSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQVNNLSSWETDSGSQLCSAMTQLRAMKHPLGLSSSANSEIGKWAPSSLAKGNGAEI

SEQ ID NO: 1027267 - protein, 1568 aa, Homo sapiens
QDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLAKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQSQTSILQGFSYSDLRKFGIVLSAVITKSWPRTADNFDDILKHLLTLADVKHVFRLCGTDEKILANVTEDAKRLIAVADSVLTKVVGDLLSGTILVGQLELIIKHKNQFLDIWQLREKSLSPQDEQCAVEEALDWRREELLLLKKEKRCVDSLLKMCGNVKHLIQVDFGVLAVRHSQDLSSKRLNDTMTVRLSTSSNSQRATHYHLSSQVQEMAGKIDLLRDSHIFQLFWREAAEPLSEPKEDQEAAELLSEPEEESERHILELQEVYDYLYQPSYRKFIKLHQDLKSGEVTLAEIDVIFKDFVNKYTDLDSELKIMCTVDHQGQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFMKHLKKLWKALDKDQYLPRKLCDSARNLEWLKTVNESHGSVERSSLTLATAINQRGIYVIQAPKGGQKISPDTVLHLILPESPGSHEESREYSLEEVKELFDKLMLMSGKKDRNNTEVERFSEVFCSVQRLSQAFIDLHSAGNMLFRTWIPWPTAPPSRVCPSKWTLAWTLVTELKEGGDVTELLAALCRQMEHFPDSWKRFRTQPTA

SEQ ID NO: 1027268 - protein, 206 aa, Homo sapiens
EFKIHFIKMLSRISGSQESQFILIREKQPWGFDHPIQGEELGVPVVTALGNLGIEGGWGCWDGQCLQLTDSGVLVNEFQSTESFFLQTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFYEASEKAVEGSG

SEQ ID NO: 1027269 - protein, 92 aa, Homo sapiens
MVLPLQVFCSVQRLSQAFIDLHSAGNMLFRTWIPWPTAPPSRVCPSKWTLAWTLVTELKEGGDVTELLAALCRQMEHFPDSWKRFQYPAHGI

SEQ ID NO: 1027270 - protein, 914 aa, Homo sapiens
RTQPCPTAKAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLAKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQVNNLSSWETDSGSQLCSAMTQLRAMKHPLGLSSSANSEIGKWAPSSLAKGNGAEI

SEQ ID NO: 1027271 - protein, 122 aa, Homo sapiens
MLSVGGLRLSLVRFSFLLLRGALLPSLAVTMTKLAQWLWGLAILGSTWVALTTGALGLELPLSCQEVLWPLPAYLLVSAGCYALGTVGYRVATFHDCEDAARELQSQIQEARADLARRGLRF

SEQ ID NO: 1027272 - protein, 110 aa, Homo sapiens
ELQLPEGRAEAEREPGRTSGRQHPGRAGKGRRGVEGSIASFSRSDHDEISAVALGTSDPGLHLGGPDHGSLGPGAALVLPGSPVATARLLAGVRRLLCPGHCGLSCGHFS

SEQ ID NO: 1027273 - protein, 92 aa, Homo sapiens
MTKLAQWLWGLAILGSTWVALTTGALGLELPLSCQEVLWPLPAYLLVSAGCYALGTVGYRVATFHDCEDAARELQSQIQEARADLARRGVRF

SEQ ID NO: 1027274 - protein, 92 aa, Homo sapiens; identical to SEQ ID NO: 1027273

SEQ ID NO: 1027275 - protein, 92 aa, Homo sapiens; identical to SEQ ID NO: 1027273

SEQ ID NO: 1027276 - protein, 303 aa, Homo sapiens
QINPASTLYSDHLSYFCFIGPFIVLALFHGKFIDTGFSLPFYQPILSKKLTIKDLESIDTECYYSPIWIRDNHPEECGLEKYFSVDLEILGKVTSHDLKLGGSNILVTEENQDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMSNGPQKFCIEKVGKDTWLPRSHTCFNRLDLPPYKSYEQLKEKLLFGNRRDRGIGTRMNVASYFGGALAFKYPSQEKLHR

SEQ ID NO: 1027277 - protein, 184 aa, Homo sapiens
RKVTFNLNQIIIELGTNPLKSSGIENGAFQGMKKLSNIRIATNITSILKVFHLTRNNILMAKKSELMQLSLKELNLAKLGLSINSISAVNLAHTPHLRELLDNNKLTRVPGGLAEHKYIQVVSLHNNNISVVGSSGFCPPGHNTKKASYSGVSLFSNPVQYWEIQPSTFRCVYVRSAIQLGNYK

SEQ ID NO: 1027278 - protein, 83 aa, Homo sapiens
RPPTPPSPPRPPPTRVIALVVSLHNNNISVVGSSGFCPPGHNTKKASYSGVSLFSNPVQYWEIQPSTFRCVYVRSAIQLGNYK

SEQ ID NO: 1027279 - protein, 374 aa, Homo sapiens
HTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMWEQNLYDFLKQNKFSPLPLKYIRPVLQQVATALMNTQKPRSYPRLTFKPRTTLIAGGIHLDNHTEVTGPSELRVQASHVCPGCVAPTYWQPTPITEALENNHVGYTYVEANG

SEQ ID NO: 1027280 - protein, 780 aa, Homo sapiens
GVYQNLSKRYQPMLGIDGLCATPSLEGFEEGEYETPGEYEEKEKHKVYELLVEHKNLNLNRTSITPQEERIAQLSESPVTTPNAKQYMPVDSLMFLSSKGSPTSTILTLSCCQVISSIAVLHAVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTSKPVDL

SEQ ID NO: 1027281 - protein, 780 aa, Homo sapiens; identical to SEQ ID NO: 1027280

SEQ ID NO: 1027282 - protein, 710 aa, Homo sapiens
GVYQNLSKRYQPMLGIDGLCATPSLEGFEEGEYETPGEYEEKEKHKVYELLVEHKNLNLNRTSITPQEERIAQLSESPVTTPNAKQYMPVDSLMFLSSKGSPTSTILTLSCCQVISSIAVLHAVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKGWRGSHPQSVEMPSLKGPNQTRF

SEQ ID NO: 1027283 - protein, 230 aa, Homo sapiens
GVYQNLSKRYQPMLGIDGLCATPSLEGFEEGEYETPGEYEEKEKHKVYELLVEHKNLNLNRTSITPQEERIAQLSESPVTTPNAKQYMPVDSLMFLSSKGSPTSTILTLSCCQVISSIAVLHAVSGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGTFTYYC

SEQ ID NO: 1027284 - protein, 775 aa, Homo sapiens
GVYQNLSKRYQPMLGIDGLCATPSLEGFEEGEYETPGEYEEKEKHKVYELLVEHKNLNLNRTSITPQEERIAQLSESPVTTPNAKQYMPVDSLMFLSSKGSPTSTILTLSCCQVISSIAVLHAVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTR

SEQ ID NO: 1027285 - protein, 258 aa, Homo sapiens
GVYQNLSKRYQPMLGIDGLCATPSLEGFEEGEYETPGEYEEKEKHKVYELLVEHKNLNLNRTSITPQEERIAQLSESPVTTPNAKQYMPVDSLMFLSSKGSPTSTILTLSCCQVISSIAVLHAVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGTFTYYC

SEQ ID NO: 1027286 - protein, 254 aa, Homo sapiens
MSAWLWRERMGAGMGFGLERMPAPIDRVGQTKENMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGNFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 1027287 - protein, 103 aa, Homo sapiens
MHCTFHKHCLLILLLLLFNFVRCKEVGSSLNACAAPFTIKEFIDNEGRACLSHLSIYLAGREEKNLPVGEEKSGVEKMGWDTTENIEKKTKLAQGVPAGCNAV

SEQ ID NO: 1027288 - protein, 112 aa, Homo sapiens
MSASGSKAGAVSPGGLSGISRGSQNGFFPGRSRLLPAPSLHPPPALCKGPRGRRRKHGEGPERRGTREAYVGKRSPLPLCSLPPGLEWLLSLLALRFREMTFSCARRECYFR

SEQ ID NO: 1027289 - protein, 259 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFGLLSPQNLAMRVSTHLNN

SEQ ID NO: 1027290 - protein, 76 aa, Homo sapiens
LCPDTKMTLDSRRALITREGKGKASTDEFPLTQVCSRPLLRFLPLRQPLSPWATPGGEGATPFPVLFIPAGLTPKH

SEQ ID NO: 1027291 - protein, 244 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027292 - protein, 244 aa, Homo sapiens; identical to SEQ ID NO: 1027291

SEQ ID NO: 1027293 - protein, 282 aa, Homo sapiens
SIVEAGRLRRHGAVPRGPPGAGHRGRQRWAAGKGGQRPAAGRGGQGTPSLSPLPAGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027294 - protein, 222 aa, Homo sapiens
SIVEAGRLRRHGAVPRGPPGAGHRGRQKCPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027295 - protein, 186 aa, Homo sapiens
MLQPFLEVTKEGDSGVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027296 - protein, 269 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQVSCPVGWTGILVSDASSAPVSLRFQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027297 - protein, 276 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCECPSCALSPTTSPSLALITDPSPSQLGFLFVGSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027298 - protein, 286 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAGESGGSPASVVPAVPVCAMGRGGRERWAAASFLYALTPALTTEVEHVVNAILFLLSDRSGMTTGSTLPVEGGFWAC

SEQ ID NO: 1027299 - protein, 217 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKVSRGLGTSPNLGHPTCPADPSCPGVDPSECSKPHSGDDVHGPGHLE

SEQ ID NO: 1027300 - protein, 217 aa, Homo sapiens; identical to SEQ ID NO: 1027299

SEQ ID NO: 1027301 - protein, 147 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQVSCPVGWTGILVSDASSASRSRCDSRLWPGA

SEQ ID NO: 1027302 - protein, 230 aa, Homo sapiens
LCPDTKMTLDSRRALITREGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAGESGGSPASVVPAVPR

SEQ ID NO: 1027303 - protein, 442 aa, Homo sapiens
WACRGAWSPGAWQHGWACVGNGGAEGLCVRVQMAVHVVTVLQLMPCSRAVYSVLLCTVFHVLLCTADCVLLRGVLACDAVTQCGILTCLVREGRSLPVSPAAVLMCCADAHVMWVLCMQMLVGWYLCCADSRLPSRALASHRGLGARAPSLWGWWPAWAAGWSAEPPGPPGSERGRNGCEAGPGQESLGRREEVNRPEVAPGCWPHSPDTFGTPNSFTCPAEKVTSPSPQLCRLLGTEPLVTAPSYTQCPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027304 - protein, 85 aa, Homo sapiens
SLSLSLSLSLSVSLSLCFLQIKHFIAELGLTGLALARAEFGTSRIPLGKFAEVEHVVNAILFLLSDRSGMTTGSTLPVEGGFWAC

SEQ ID NO: 1027305 - protein, 248 aa, Homo sapiens
LCPDTKMTLDSRRALITREGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027306 - protein, 307 aa, Homo sapiens
SIVEAGRLRRHGAVPRGPPGAGHRGRQRWAAGKGGQRPAAGRGGQGTPSLSPLPAGIGRGTVQALHATGARVVAVSRTQADLDSLVREVTSPSPQLCRLLGTEPLVTAPSYTQCPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027307 - protein, 373 aa, Homo sapiens
WACRGAWSPGAWQHGWACVGNGGAEGLCVRVQMAVHVVTVLQLMPCSRAVYSVLLCTVFHVLLCTADCVLLRGVLACDAVTQCGILTCLVREGRSLPVSPAAVLMCCADAHVMWVLCMQMLVGWYLCCADSRLPSRALASHRGLGARAPSLWGWWPAWAAGWSAEPPGPPGSERGRNGCEAGPGQESLGRREEVNRPEVAPGCWPHSPDTFGTPNSFTCPAEKVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027308 - protein, 140 aa, Homo sapiens
MPALLTVSLRFQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 1027309 - protein, 232 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAGPTDVHNRGAEKTVVYAEISRK

SEQ ID NO: 1027310 - protein, 190 aa, Homo sapiens
SIVELGDCADMELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCECPSCALSPTPAPASPSSPTPAPASLGSSS

SEQ ID NO: 1027311 - protein, 321 aa, Homo sapiens
SIVEAGRLRRHGAVPRGPPGAGHRGRQRWAAGKGGQRPAAGRGGQGTPSLSPLPAGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGCHGFIAGKGALAGGPPNSAQAVIYPILKRSAKKHNKIKKNRIRKKKRQNPLESLV

SEQ ID NO: 1027312 - protein, 220 aa, Homo sapiens
SIVELGDCADMELFLAGRRVLVTGAGKGIGRGTVQALHATGARVVAVSRTQADLDSLVRECPGIEPVCVDLGDWEATERALGSVGSVDLLVNNASVALLQPFLEVTKEGDSAYDRSFDENLSAIIHVSQIVVSGFIARCVPDAIVNVCRQCSQGSVTNYSVYCSTKGALDMLTKVMALELGPHKIRVNAVNPTVVMTSMGQATWSDPHKAKTMLNRIPLC

SEQ ID NO: 1027313 - protein, 244 aa, Homo sapiens; identical to SEQ ID NO: 1027291

SEQ ID NO: 1027314 - protein, 244 aa, Homo sapiens; identical to SEQ ID NO: 1027291

SEQ ID NO: 1027315 - protein, 287 aa, Homo sapiens
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKADYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHSVVSLHCPRCLELWTQASNLIQLP

SEQ ID NO: 1027316 - protein, 313 aa, Homo sapiens
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKADYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 1027317 - protein, 161 aa, Homo sapiens
MIRDLGTKWPFLGSRRQNQGTNVGGLAHPPGPKRVVECTASFRKMARPAVTTPPGLLMYMWMGFLVLSDFREEELCDNKAGNAVIDRAHDAHDAVPQQPRVDVIGALAATRLLHHDGNERESPGAVACRHRCRPGRSGVSLRLLRWKVSGERGPSAGYLHD

SEQ ID NO: 1027318 - protein, 1526 aa, Homo sapiens
RGSQTPQSRGTFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1027319 - protein, 1526 aa, Homo sapiens; identical to SEQ ID NO: 1027318

SEQ ID NO: 1027320 - protein, 839 aa, Homo sapiens
ATVIYGVAVGGGGGREYPGLKPLPSSEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1027321 - protein, 746 aa, Homo sapiens
MPVETAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1027322 - protein, 428 aa, Homo sapiens
MCMAGPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1027323 - protein, 415 aa, Homo sapiens
ALRHHFAVHGTGAAIAAVANPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1027324 - protein, 1526 aa, Homo sapiens; identical to SEQ ID NO: 1027318

SEQ ID NO: 1027325 - protein, 332 aa, Homo sapiens
PGPQACGRVTGDPRAWGDVQPVPGTHRGKFRKEGLMQLSQAQAAGASPQRCWHTSPEAVHPLHQDYANRKALFNLWRALMRVGLRHFSPSPTTGQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1027326 - protein, 1526 aa, Homo sapiens; identical to SEQ ID NO: 1027318

SEQ ID NO: 1027327 - protein, 1384 aa, Homo sapiens
RGSQTPQSRGTFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPTQ

SEQ ID NO: 1027328 - protein, 1526 aa, Homo sapiens; identical to SEQ ID NO: 1027318

SEQ ID NO: 1027329 - protein, 1444 aa, Homo sapiens
RGSQTPQSRGTFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMYEGGEPDDVGGLLDADFALDPDKPTNFTNPVYATLYMGGHGSRHSLASTDEKRELLGRGPEDEIGDPLA

SEQ ID NO: 1027330 - protein, 427 aa, Homo sapiens
MWLSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1027331 - protein, 293 aa, Homo sapiens
GSGVNRHEAGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1027332 - protein, 1526 aa, Homo sapiens; identical to SEQ ID NO: 1027318

SEQ ID NO: 1027333 - protein, 1454 aa, Homo sapiens
RGSQTPQSRGTFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPT

SEQ ID NO: 1027334 - protein, 551 aa, Homo sapiens
RGSQTPQSRGTFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCIAGRCNAMETIDCPHRHTVPT

SEQ ID NO: 1027335 - protein, 136 aa, Homo sapiens
MAEVVAKLEGPPFIIEAAVRVNAAVLDYCRTFVSALSGATAGILGLTGLYGFIFYLLASVLLSLLPFSRREGGGTNISNPGEPVIFVPPPAPHSQGGKEVEQIFQITETFFTGGLIGGLFTYVLFWTFLYGMVHVY

SEQ ID NO: 1027336 - protein, 963 aa, Homo sapiens
LCSHLWQPGLGSCWSEGFPEAGSTHSRLCLLLCWTLIEAVGSRAKKEAAAEEAKVGWGCPALRPEVPLTLRARAISLMASSGRKLWLRYPSFLPAAWICLLPGWERLGRPRWGCQGQRLFQKCPLLPIRGFGWHLLVAWGAGSRGARLRAVEPQGSCPSAAMLTPAELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 1027337 - protein, 918 aa, Homo sapiens
LCSHLWQPGLGSCWSEGFPEAGSTHSRLCLLLCWTLIEAVGSRAKKEAAAEEAKVGWGCPALRPEVPLTLRARAISLMASSGRKLWLRYPSFLPAAWICLLPGWERLGRPRWGCQGQRLFQKCPLLPIRGFGWHLLVAWGAGSRGARLRAVEPQGSCPSAAMLTPAELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTVDHFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 1027338 - protein, 833 aa, Homo sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 1027339 - protein, 628 aa, Homo sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAPTWPRGSVVFYTCLLPVQGWERLCEGREGRGWACCGQWHTLFQP

SEQ ID NO: 1027340 - protein, 91 aa, Homo sapiens
GPVCSSVLARGLLGVGRSGHLAAASNTGTQPRQGTHPTRQPHQPQVFHVGPGPPRSADWACHYTSDASHLAPGFSGILYLPSSCTGLGKAV

SEQ ID NO: 1027341 - protein, 833 aa, Homo sapiens; identical to SEQ ID NO: 1027338

SEQ ID NO: 1027342 - protein, 595 aa, Homo sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLALPDSNPEESSV

SEQ ID NO: 1027343 - protein, 833 aa, Homo sapiens; identical to SEQ ID NO: 1027338

SEQ ID NO: 1027344 - protein, 472 aa, Homo sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQTPRFAQPGSFEYEYAMRWKALIEMEKQQQDQVDRNHQEEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 1027345 - protein, 472 aa, Homo sapiens; identical to SEQ ID NO: 1027344

SEQ ID NO: 1027346 - protein, 472 aa, Homo sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQTPRFAQPGSFEYEYAMRWKALIEMEKQQQDQVDRNHQEEAREKLEMEMEAARHEHQVMLMRQDLMRRQEELRRMEELHNQEVQKRKQLELRQEEERRRREEEMRRQQEEMMRRHEEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 1027347 - protein, 42 aa, Homo sapiens
MRAGMLTHAEACVFPEDVAVVRQEAAPQPGFPCDPPVGLDQG

SEQ ID NO: 1027348 - protein, 127 aa, Homo sapiens
LRSSPKLTAPRLCSQAGRPSASVEVCRVVSPPAGVTQSLSAAQKAGWHCLRLRSRQVRVLLHALVTSVLTAVHQLLLHLLVRRLALSRLLRTEMLLRSRRCRYSGLPRYGPLLPALFSRAGPGAGVC

SEQ ID NO: 1027349 - protein, 257 aa, Homo sapiens
HDSGCRATRKYSNFALSGLGGSRARSGRATMGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKTPGKVGAETLGRLIAIKKWGRAPMVGCPVTADVINPIACDKREELREKLAAAKEKRLEPKAGEDKTLGEDDRGLEETELDREELEVQKEKAWIEEGEVTGGR

SEQ ID NO: 1027350 - protein, 289 aa, Homo sapiens
HDSGCRATRKYSNFALSGLGGSRARSGRATMGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKTPGKVGAETLGRLIAIKKAQWAWGIGLTLGPPFQKAGTKEEPVDSCCHQTLIGPLAEMRKREASREKAGRVGQRKKALVGNTKMGGRKKKPWGRCNPPLVAQFGVELKRARIWIMEKAWEKGQFGGRPMWVIGG

SEQ ID NO: 1027351 - protein, 140 aa, Homo sapiens
RTSGFAAFGSGSGGWVERSPVRLSSAVGQCEFVTAAVAPRPRAAEVRGGRGRRKRSGSRFRSVFARVEAIPESGGKDKPRLRSYRVTLRKESTMAQESPKNSAAEIPVTSNGEVDDSREHSFNRVRTIFFLLMQRIMISL

SEQ ID NO: 1027352 - protein, 505 aa, Homo sapiens
RTSGFAAFGSGSGGWVERSPVRLSSAVGQCEFVTAAVAPRPRAAEVRGGRGRRKRSGSRFRSVFARVEAIPESGGKDKPRLRSYRVTLRKDLNLLPRLECSVTVSAYCNLCLPGEAILLPQLPESLGPQESTMAQESPKNSAAEIPVTSNGEVDDSREHSFNRDLKHSLPSGLGLSETQITSHGFDNTKEGVIEAGAFQGSPAPPLPSVMSPSRVAASRLAQQGSDLIVPAGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 1027353 - protein, 418 aa, Homo sapiens
RTSGFAAFGSGSGGWVERSPVRLSSAVGQCEFVTAAVAPRPRAAEVRGGRGRRKRSGSRFRSVFARVEAIPESGGKDKPRLRSYRVTLRKESTMAQESPKNSAAEIPVTSNGEVDDSREHSFNRDLKHSLPSGLGLSETQITSHGFDNTKEGVIEAGAFQGSPAPPLPSVMSPSRVAASRLAQQGSDLIVPAGGQRTQTKSGPVILADEIKNPAMEKLELVRKWSLNTYKLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 1027354 - protein, 341 aa, Homo sapiens
MAQESPKNSAAEIPVTSNGEVDDSREHSFNRDLKHSLPSGLGLSETQITSHGFDNTKEGVIEAGAFQGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 1027355 - protein, 466 aa, Homo sapiens
RTSGFAAFGSGSGGWVERSPVRLSSAVGQCEFVTAAVAPRPRAAEVRGGRGRRKRSGSRFRSVFARVEAIPESGGKDKPRLRSYRVTLRKESTMAQESPKNSAAEIPVTSNGEVDDSREHSFNRDLKHSLPSGLGLSETQITSHGFDNTKEGVIEAGAFQGSPAPPLPSVMSPSRVAASRLAQQGSDLIVPAGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 1027356 - protein, 434 aa, Homo sapiens
RTSGFAAFGSGSGGWVERSPVRLSSAVGQCEFVTAAVAPRPRAAEVRGGRGRRKRSGSRFRSVFARVEAIPESGGKDKPRLRSYRVTLRKESTMAQESPKNSAAEIPVTSNGEVDDSREHSFNRDLKHSLPSGLGLSETQITSHGFDNTKEGVIEAGAFQGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLEEQ

SEQ ID NO: 1027357 - protein, 484 aa, Homo sapiens
RTSGFAAFGSGSGGWVERSPVRLSSAVGQCEFVTAAVAPRPRAAEVRGGRGRRKRSGSRFRSVFARVEAIPESGGKDKPRLRSYRVTLRKESTMAQESPKNSAAEIPVTSNGEVDDSREHSFNRDLKHSLPSGLGLSETQITSHGFDNTKEGVIEAGAFQGSPAPPLPSVMSPSRVAASRLAQQGSDLIVPAGGQRTQTKSGPVILADEIKNPAMEKLELVRKWSLNTYKCTRQIISEKLGRGSRTVDLELEAQIDILRDNKKKYENILKLAQTLSTQLFQMVHTQRQLGDAFADLSLKSLELHEEFGYNADTQKLLAKNGETLLGAINFFIASVNTLVNKTIEDTLMTVKQYESARIEYDAYRTDLEELNLGPRDANTLPKIEQSQHLFQAHKEKYDKMRNDVSVKLKFLEENKVKVLHNQLVLFHNAIAAYFAGNQKQLEQTLKQFHIKLKTPGVDAPSWLATAHSQNPPAAQHHTHSTSPP

SEQ ID NO: 1027358 - protein, 341 aa, Homo sapiens; identical to SEQ ID NO: 1027354

SEQ ID NO: 1027359 - protein, 98 aa, Homo sapiens
DLLEEKDVGGACGKAPGRKGKGPSRLHRQGRHCAGQQHHGVVGGQQRAELGVGTMCSGPWRPWPAPHDGAEAHVDRADVGCSALLGNVVALSTTWFYQ

SEQ ID NO: 1027360 - protein, 109 aa, Homo sapiens
RTSGFAAFGSGSGGWVERSPVRLSSAVGQCEFVTAAVAPRPRAAEVRGGRGRRKRSGSRFRSVFARVEAIPESGGKDKPRLRSYRVTLRKVWVLIRKAARSTCLQDSRS

SEQ ID NO: 1027361 - protein, 142 aa, Homo sapiens
MIHQLATVVQQKSNGMKDAGPSSPAVSNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGHWDPGQSQVQ

SEQ ID NO: 1027362 - protein, 190 aa, Homo sapiens
MIHQLATVVQQKSNGMKDAGPSSPAVSNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPNVATTGTGKTRQNSSQHRVSTPPEACTQHPQATRSTGAPRVPTCRGPSFQ

SEQ ID NO: 1027363 - protein, 205 aa, Homo sapiens
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 1027364 - protein, 205 aa, Homo sapiens; identical to SEQ ID NO: 1027363

SEQ ID NO: 1027365 - protein, 229 aa, Homo sapiens
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFRDWYPHSRLFDQASGCPGCRRSGRSGYGGSSWPEAAKSDETAAK

SEQ ID NO: 1027366 - protein, 223 aa, Homo sapiens
LGRGWVEIGRGSRAESASMTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 1027367 - protein, 229 aa, Homo sapiens
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKQTNEITIPVTFESRAQLAGPEAAKSDETAAK

SEQ ID NO: 1027368 - protein, 367 aa, Homo sapiens
KFVLLLSLIGFCWAQYDPHTSDGRTAIVHLFEWRWVDIAKICERYLAPKGFGGVQVSPPNENVVVHNPSRPWWERYQPISYKICTRSGNEDEFRDMVTRCNNVGVIDLGGEAIKGSEYFGNGRVTEFKYGAKLGTVIRKWNGEKMSYLKNWGEGWGMVPSDRALVFVDNHDNQRGHGAGGSSILTFWDARMYKMAVGFMLAHPYGFTRVMSSYRWNRNFQNGKDQNDWIGPPNNNGVTKEVTINADTTCGNDWVCEHRWRQIRNMVAFRNVVNGQPFSNWWDNNSNQVAFSRGNRGFIVFNNDDWALSATLQTGLPAGTYCDVISGDKVDGNCTGLRVNVGSDGKAHFSISNSAEDPFIAIHADSKL

SEQ ID NO: 1027369 - protein, 507 aa, Homo sapiens
KFVLLLSLIGFCWAQYDPHTSDGRTAIVHLFEWRWVDIAKICERYLAPKGFGGVQVSPPNENVVVHNPSRPWWERYQPISYKICTRSGNEDEFRDMVTRCNNVGVRIYVDAVINHMCGAGNPAGTSSTCGSYLNPNNREFPAVPYSAWDFNDNKCNGEIDNYNDAYQVRNCRLTGLLDLALEKDYVRTKVADYMNHLIDIGVAGFRLDAAKHMWPGDIKAVLDKLHNLNTKWFSQGSRPFIFQEVIDLGGEAIKGSEYFGNGRVTEFKYGAKLGTVIRKWNGEKMSYLKNWGEGWGMVPSDRALVFVDNHDNQRGHGAGGSSILTFWDARMYKMAVGFMLAHPYGFTRVMSSYRWNRNFQNGKDQNDWIGPPNNNGVTKEVTINADTTCGNDWVCEHRWRQIRNMVAFRNVVNGQPFSNWWDNNSNQVAFSRGNRGFIVFNNDDWALSATLQTGLPAGTYCDVISGDKVDGNCTGLRVNVGSDGKAHFSISNSAEDPFIAIHADSKL

SEQ ID NO: 1027370 - protein, 507 aa, Homo sapiens; identical to SEQ ID NO: 1027369

SEQ ID NO: 1027371 - protein, 189 aa, Homo sapiens
VLVSCRAGPGSGRVGHHHLTGLAGGTGLCGPAAICEARGDGRGGGWPVGFPQRGQVAWRERGSGTGSLVGGADAPRPGVALPGHWWDPCSGLLSGCQLCLKDSWNLRTRSRSALGPGPHAGPGGTTQPGIVHGQRCSPRALLGSLTERLLWLKVGWGRGLGPPWLSPVRPGAPPAGSAPGLRWCGALSG

SEQ ID NO: 1027372 - protein, 189 aa, Homo sapiens; identical to SEQ ID NO: 1027371

SEQ ID NO: 1027373 - protein, 129 aa, Homo sapiens
MAGGCRYSWGPSGGSAKDPTPTPGAFCSQRPPIRARTLGNARGSRGKSPGTGPPLRGVGCFLGTLSFPALAGWLAVKHLKPPGRQPLKSRSWPPWPQKTYPAVYVSRALPGGFPSLPHRAGDGKRWREE

SEQ ID NO: 1027374 - protein, 129 aa, Homo sapiens; identical to SEQ ID NO: 1027373

SEQ ID NO: 1027375 - protein, 123 aa, Homo sapiens
RRHHHRMESNGIIERTRMETSNGIEWNHHRMRSNGIMNNIEWNHRRMESNGIIKWTRTESSWNVIEENLLMDSSGIIIEGKRMESSSNEIECIIIKWNRVEALSGLKRNVDAAANLVVVVGGR

SEQ ID NO: 1027376 - protein, 108 aa, Homo sapiens
EVAPVSWSGRGLLPGSGSAGGTVNQSWHPHPGQRGLWFSASEGSAAPLLFRLQGCHLLSPQVVWPLWSILGIRFSSRALASCLFFNWEHRLSQDQNPHSPPRSYLASL

SEQ ID NO: 1027377 - protein, 108 aa, Homo sapiens; identical to SEQ ID NO: 1027376

SEQ ID NO: 1027378 - protein, 108 aa, Homo sapiens; identical to SEQ ID NO: 1027376

SEQ ID NO: 1027379 - protein, 173 aa, Homo sapiens
MCWYGRSTGWAMALLTPGVKEVFQFQRPQGRERLRRLLNWEEFDEQRDSRRSILLDTLYESIIFAVGKGFPWVEVAQVVKFTEELLRETKGCSITEAVTILGNKLRDYRGHFNTTHLLALCDYFHHTFIRHYKLYQYVLGQDQQVDLTVAHLEVCMPPLSRPPSPATQARRKP

SEQ ID NO: 1027380 - protein, 132 aa, Homo sapiens
MCWYGRSTGWAMALLTPGVKEVFQFQRPQGRERLRRLLNWEEFDEQRDSRRSILLDTLYESIIFAVGKGFPWVEVAQVVKFTEELLRETKVTKRKEYSYREEADSCLLSQMIQVDIVSKRPHTESRVPGQTQ

SEQ ID NO: 1027381 - protein, 237 aa, Homo sapiens
MCWYGRSTGWAMALLTPGVKEVFQFQRPQGRERLRRLLNWEEFDEQRDSRRSILLDTLYESIIFAVGKGFPWVEVAQVVKFTEELLRETKEFSPGAHTAHQLCRNASRGLMMAMTVTMALLIECLLCTRHCGKHHICMLSPNLRGRDFYCLYFTGCSITEAVTILGNKLRDYRGHFNTTHLLALCDYFHHTFIRHYKLYQYVLGQDQQVDLTVAHLEVCMPPLSRPPSPATQARRKP

SEQ ID NO: 1027382 - protein, 87 aa, Homo sapiens
QPGQVLERQELESLICQAVHTQMDLLQELLQRQIQNTFAILDLKLQKKTLNLNAPTPIPPPITSHAGQEEALKPQRASKGKKAKARK

SEQ ID NO: 1027383 - protein, 279 aa, Homo sapiens
GQRLVTQIATTPQFPNMILSASRDKTIIMWKLTRDETNYGIPQRALRGNSHFVSDVVSPQMDSFPSQLWDEPCASGVSQRAPPRGDLWPIPRIVLSVAFSSDNRQIVSGSRDYTLKLWNTLGVCKYTVQDESHSEWVSCVRFSPHSSNPIIVSCGWDQLVKVWNLANCQLKTHPLGPTGYLNPVTVSPDGSLCASGGKDGQAMLWDLNEGKHLYTLDGGDIINALCFSPNRYWLCAATGPSIKIWDLEGKILVDELKQEVISTSSKAEPPPVHLPGLVC

SEQ ID NO: 1027384 - protein, 279 aa, Homo sapiens; identical to SEQ ID NO: 1027383

SEQ ID NO: 1027385 - protein, 97 aa, Homo sapiens
VGGEERRAEGGGGGLVQAHAMLWDLNEGKHLYTLDGGDIINALCFSPNRYWLCAATGPSIKIWDLEGKILVDELKQEVISTSSKAEPPPVHLPGLVC

SEQ ID NO: 1027386 - protein, 136 aa, Homo sapiens
APLDSPQVASTHVLPSWGDGFLWPSPPSPVDLCEMQPQKEQGPRGRSPGGSWFRVFTQTLGPLKGAFSGLPPATASSLASAFHPSSSLPRGPDACAPARPRLFTPFTAVHALNATRVRDASSGVLGCCRRLGVFKW

SEQ ID NO: 1027387 - protein, 124 aa, Homo sapiens
TSIMSAPEIFIMCLKKTRDNAVRRPFHGKKEENNGLNQSLMSQSMSSVSSRHFEKIAIRDFQSLYLPLDLKPGEGASGASRRPWVLGKVMEKEYCQAKKAQNRFKVPLGTKFYRVKAVSWNKKV

SEQ ID NO: 1027388 - protein, 124 aa, Homo sapiens; identical to SEQ ID NO: 1027387

SEQ ID NO: 1027389 - protein, 184 aa, Homo sapiens
MVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 1027390 - protein, 223 aa, Homo sapiens
SGGLGAPRRKSRGCQNALSASGPAAAAAAIMVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEGTAKETFFRNSPWGGKKR

SEQ ID NO: 1027391 - protein, 184 aa, Homo sapiens; identical to SEQ ID NO: 1027389

SEQ ID NO: 1027392 - protein, 189 aa, Homo sapiens
SGGLGAPRRKSRGCQNALSASGPAAAAAAIMVRKLKFHEQKLLKQVDFLNWEVTDHNLHELRVLRRYRLQRREDYTRYNQLSRAVRELARRLRDLPERDQFRVRASAALLDKLYALGLVLLKLRMAQHLQAAVAFVEQGHVRVGPDVVTDPAFLVTRSMEDFVTWVDSSKIKRHVLEYNEERDDFDLEA

SEQ ID NO: 1027393 - protein, 95 aa, Homo sapiens
SGGLGAPRRKSRGCQNALSASGPAAAAAAIMVRKLKFHEQKLLKQVDFLNWEVTDHNLHELRVLRRYRRAPQAAHGAAPSGCRGLCGARARTRGP

SEQ ID NO: 1027394 - protein, 214 aa, Homo sapiens
SGGLGAPRRKSRGCQNALSASGPAAAAAAIMVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 1027395 - protein, 214 aa, Homo sapiens; identical to SEQ ID NO: 1027394

SEQ ID NO: 1027396 - protein, 192 aa, Homo sapiens
SGGLGAPRRKSRGCQNALSASGPAAAAAAIMVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTSAMTSIWKPSGSPTLHGCLLQMGKLRPDAGDSMRVLSSRVSDGRRFLRI

SEQ ID NO: 1027397 - protein, 184 aa, Homo sapiens; identical to SEQ ID NO: 1027389

SEQ ID NO: 1027398 - protein, 184 aa, Homo sapiens; identical to SEQ ID NO: 1027389

SEQ ID NO: 1027399 - protein, 342 aa, Homo sapiens
AFVRSKVASTFPERLLRFCLDRPLTTDMSRDRFRSRGGGGGGFHRRGGGGGRGGSTTSVLRRPAWASIRIAAPWVLARARAALSLRSRHRLHTNSSNSHHRSSHRRSSRHRISRRRIHSRISSSSRRHRRRTLPSPSLLRDPAPHPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGAARRRSRTRRGLKPIVSLEEAGEKTYTQDVGSKLGIYLLISRRIIQKDY

SEQ ID NO: 1027400 - protein, 240 aa, Homo sapiens
AFVRSKVASTFPERLLRFCLDRPLTTDMSRDRFRSRGGGGGGFHRRGGGGGRGGSTTSVLRRPAWASIRIAARPDSDPAACSHLGPSRGAAPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGAARRRSRTRRGLKPIVSLEEAGEKTYTQDVGSKLGIYLLISRRIIQKDY

SEQ ID NO: 1027401 - protein, 184 aa, Homo sapiens
MATALALRSLYRARPSLRCPPVELPWAPRRGHRLSPADDELYQRTRISLLQREAAQAMYIDSYNSRGFMINGNRVLGPCALLPHSVVQWNVGSHQDITEDSFSLFWLLEPRIEIVVVGTGDRTERLQSQVLQAMRQRGIAVEVQDTPNACATFNFLCHEGRVTGAALIPPPGGTSLTSLGQAAQ

SEQ ID NO: 1027402 - protein, 184 aa, Homo sapiens; identical to SEQ ID NO: 1027401

SEQ ID NO: 1027403 - protein, 127 aa, Homo sapiens
MYIDSYNSRGFMINGNRVLGPCALLPHSVVQWNVGSHQDITEDSFSLFWLLEPRIEIVVVGTGDRTERLQSQVLQAMRQRGIAVEVQDTPNACATFNFLCHEGRVTGAALIPPPGGTSLTSLGQAAQ

SEQ ID NO: 1027404 - protein, 127 aa, Homo sapiens; identical to SEQ ID NO: 1027403

SEQ ID NO: 1027405 - protein, 184 aa, Homo sapiens; identical to SEQ ID NO: 1027401

SEQ ID NO: 1027406 - protein, 197 aa, Homo sapiens
MPKPRAGASDSRASRPLTWIKDGGTGDSQDASRVNEDKGAPRRGHRLSPADDELYQRTRISLLQREAAQAMYIDSYNSRGFMINGNRVLGPCALLPHSVVQWNVGSHQDITEDSFSLFWLLEPRIEIVVVGTGDRTERLQSQVLQAMRQRGIAVEVQDTPNACATFNFLCHEGRVTGAALIPPPGGTSLTSLGQAAQ

SEQ ID NO: 1027407 - protein, 184 aa, Homo sapiens
MATALALRSLYRARPSLRCPPVELPWAPRRGHRLSPADDELYQRTRISLLQREAAQAMYIDSYNSRGFMINGNRVLGPCALLPHSVVQWNVGSHQDITEDSFSLFWLLEPRIEIVVVGTGDRTERLQSQVLQAMRQRGIAVEVQDTVSPGTGACCGEHRPGARQADAGLFFAAQCLCHLQLPVS

SEQ ID NO: 1027408 - protein, 184 aa, Homo sapiens; identical to SEQ ID NO: 1027401

SEQ ID NO: 1027409 - protein, 217 aa, Homo sapiens
MLINRYSPAAPPPQRPGPSSHRTICATPSASAWTRPTCGCLWTASFATPPSDLGLQCDAVNLAFGRRCEELEDVRHKLQHHLHKMLREITDQEHNVVALKEAIKDKEEPLHIAQTRLYLPSHRPNMQLCREAAQFSPSSPPPNTPKLVSEVEELYKSITVPREKLLQAEQSLCNLEDIHMSLEKDVTAMTNSLFIDRQKYMAHRTCYPTILQLAGYQ

SEQ ID NO: 1027410 - protein, 189 aa, Homo sapiens
GRADPSGCRVAEQPGAWCYVPVRYVSSCLWVCQERIRDDINLLPGSASTPETRTKFTQDNLCHAQRERLDSANLWVLVDCILRDTSEDLGLQCDAVNLAFGRRCEELEDVRHKLQHHLHNGAGTLNPRRRLRRLPTHSDPSHHLALGPQTAINSRRDPSYIPREPRSKCHTLPKAYVKPGDTGYDRKVM

SEQ ID NO: 1027411 - protein, 137 aa, Homo sapiens
AFTLIVTRQFTHIELNFNEPPQPGSASTPETRTKFTQDNLCHAQRERLDSANLWVLVDCILRDTSKLVSEVEELYKSITVPREKLLQAEQSLCNLEDIHMSLEKDVTAMTNSLFIDRQKYMAHRTCYPTILQLAGYQ

SEQ ID NO: 1027412 - protein, 208 aa, Homo sapiens
SLFRLLICKHKAASIGSRLLAGQTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 1027413 - protein, 130 aa, Homo sapiens
TLMTRSLVEMPPLCPPLCCPIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 1027414 - protein, 232 aa, Homo sapiens
KPLQWAVARLQRANEFASVRIACMICQTVYTKGSEHASIGSRLLAGQTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 1027415 - protein, 232 aa, Homo sapiens; identical to SEQ ID NO: 1027414

SEQ ID NO: 1027416 - protein, 115 aa, Homo sapiens
SHRHTITHTLFLPQRRTITYTDTDTQRHRHTNIDTHTQTHTRHAKTHRHRYTDTKTQTYRHTDMHRDTWRHMQKCTEKDIQKCTHRHIDHTDTQTCMQTHRHADMHTNTDARTQT

SEQ ID NO: 1027417 - protein, 107 aa, Homo sapiens
LAQTHNHTHPLLATETHHYIHRHRQDTHTQTHTRHAKTHRHRYTDTKTQTYRHTDMHRDTWRHMQKCTEKDIQKCTHRHIDHTDTQTCMQTHRHADMHTNTDARTQT

SEQ ID NO: 1027418 - protein, 152 aa, Homo sapiens
EFLHGTKRDDGQASIPTEISGNSPVSPNTQDKSVGQSPLRSPLKRQASVCSTRLGSTKSLTAAFYGDKQPVTVGVQFSSDVSRSDENVLDSPKQRRSFGSFPYTPSADSNSFHQYRSMDSSMSMADSEAYFSAAEEFEPISSDEGPGTYPGR

SEQ ID NO: 1027419 - protein, 157 aa, Homo sapiens
EFLHGTKRDDGQASIPTEISGNSPVSPNTQDKSVGQSPLRSPLKRQASVCSTRLGSTKSLTAAFYGDKQPVTVGVQFSSDVSRSDENVLDSPKQRRSFGSFPYTPSADSNSFHQYRSMDSSMSMADSEAYFSAAEEFEPISSDEGPDKFQGLRRRGR

SEQ ID NO: 1027420 - protein, 103 aa, Homo sapiens
MSDCYTELEKAVIVLVENFYKYVSKYSLVKNKISKSSFREMLQKELNHMLSDTGNRKAADKLIQNLDANHDGRISFDEYWTLIGGITGPIAKLIHEQEQQSSS

SEQ ID NO: 1027421 - protein, 103 aa, Homo sapiens; identical to SEQ ID NO: 1027420

SEQ ID NO: 1027422 - protein, 103 aa, Homo sapiens; identical to SEQ ID NO: 1027420

SEQ ID NO: 1027423 - protein, 103 aa, Homo sapiens; identical to SEQ ID NO: 1027420

SEQ ID NO: 1027424 - protein, 120 aa, Homo sapiens
MSPTEAAAGTTQGKATHILKRTPRRGAPTHNKQTNPLNNRTHTRRLHSYTRGQRKAHQPRNTAGAQLSLESHHPDDEGESPNKAKNHNRQPTTGAANTDTPRQGERRTTAEIAEEQPPRN

SEQ ID NO: 1027425 - protein, 103 aa, Homo sapiens; identical to SEQ ID NO: 1027420

SEQ ID NO: 1027426 - protein, 103 aa, Homo sapiens; identical to SEQ ID NO: 1027420

SEQ ID NO: 1027427 - protein, 103 aa, Homo sapiens; identical to SEQ ID NO: 1027420

SEQ ID NO: 1027428 - protein, 103 aa, Homo sapiens; identical to SEQ ID NO: 1027420

SEQ ID NO: 1027429 - protein, 112 aa, Homo sapiens
MSDCYTELEKAVIVLVENFYKYVSKYSLVKNKISKSSFREMLQKELNHMLSQLLTLLPPQDTGNRKAADKLIQNLDANHDGRISFDEYWTLIGGITGPIAKLIHEQEQQSSS

SEQ ID NO: 1027430 - protein, 103 aa, Homo sapiens; identical to SEQ ID NO: 1027420

SEQ ID NO: 1027431 - protein, 103 aa, Homo sapiens; identical to SEQ ID NO: 1027420

SEQ ID NO: 1027432 - protein, 103 aa, Homo sapiens; identical to SEQ ID NO: 1027420

SEQ ID NO: 1027433 - protein, 172 aa, Homo sapiens
PAWEWEWPQVANGKQVAGQEAVCGGLTEQPFLPNLTVACSGPYGGCDPVLSISFHQDPPGGPASRRSREMSDCYTELEKAVIVLVENFYKYVSKYSLVKNKISKSSFREMLQKELNHMLSDTGNRKAADKLIQNLDANHDGRISFDEYWTLIGGITGPIAKLIHEQEQQSSS

SEQ ID NO: 1027434 - protein, 120 aa, Homo sapiens
MSPSEAAAGTTQGKATHILKRTPRRGAPTHNKQTNPLNNRTHTRRLHSYTRGQRKAHQPRNTAGAQLSLESHHPDDEGESPNKAKNHNRQPTTGAANTDTPRQGERRTTAEIAEEQPPRN

SEQ ID NO: 1027435 - protein, 120 aa, Homo sapiens; identical to SEQ ID NO: 1027424

SEQ ID NO: 1027436 - protein, 173 aa, Homo sapiens
MLAEKLPNLTHLNLSGNKLKDISTLEPLKKLECLKSLDLFNCEVTNLNDYRESVFKLLPQLTYLDGYDREDQEAPDSDAEVDGVDEEEEDEEGEDEEDEDDEDGEEEEFDEEDDSTMKNVDGDEGRPMKFSEEGKKEFGLDEEDEDEDEDEEEEEGGKGEKRKRETDDEGEDD

SEQ ID NO: 1027437 - protein, 152 aa, Homo sapiens
MKGLGTDEDSLIEIICSRTNQELQEINRVYKEMYKTDLEKDIISDTSGDFRKLMVALAKGRRAEDGSVIDYELIDQDARDLYDAGVKRRKEVPGAQILDGGRAHFQSFEGQSAAFDVERFATGNGTEGLAVGLKNPFVTVSHKGGKRHKTQR

SEQ ID NO: 1027438 - protein, 206 aa, Homo sapiens
MKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIPARH

SEQ ID NO: 1027439 - protein, 206 aa, Homo sapiens; identical to SEQ ID NO: 1027438

SEQ ID NO: 1027440 - protein, 118 aa, Homo sapiens
ALLSIWGRSQLSAHGPASFKMSTVHEILCKLSLEGDHSTPPSAYGSVKAYTNFDAERDALNIETAIKTKGVDEVTIVNIFDQPQQCTETGYCLRLPEKDQKGTCISTEVSLIWATWRR

SEQ ID NO: 1027441 - protein, 461 aa, Homo sapiens
ALLSIWGRSQLSAHGPASFKMSTVHEILCKLSLEGDHSTPPSAYGSVKAYTNFDAERDALNIETAIKTKGVACRSTHCQTILHPHRQQHSHSSTRHHCASAVTQQQGTKQQAHYAIQPLQVQAFIMAHPGSTYKAFIGPSLAQAPPYTPGHSTALMQTKTAITHDKRGSETPARQALSSIAESIIGSQGNPTAGQARRGNTFTPSKSYQRANMVPKHMHRGQQRTNIIIQGTTNPGEHFPDKQQCTAEQAHMAKKGDTDNEPQRRERAYLTTEAVIEPEHYAPQAMPPGETIKWNGQRTSTEPNPPHPRTVTTNGGDHANEGTRSGADEGPPPITREKKYEKKVPKDGSTAQTREAWESETEENRAHRKTRHTGSTRNRNTAPRQPPTPAQAHNAAAAPRHRTRHHRKRHTQKRNHTKHGPITHQASNQTREKQHINHQQPGHNTRHHAETAHTANVRPQT

SEQ ID NO: 1027442 - protein, 206 aa, Homo sapiens; identical to SEQ ID NO: 1027438

SEQ ID NO: 1027443 - protein, 359 aa, Homo sapiens
ALLSIWGRSQLSAHGPASFKMSTVHEILCKLSLEGDHSTPPSAYGSVKAYTNFDAERDALNIETAIKTKGVDEVTIVNLWYRARSRQLRTAQNMDEFVLYDLTRDEYGPMKETCRSREHGDSRTVSGAPCEYPVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIPARH

SEQ ID NO: 1027444 - protein, 2644 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 1027445 - protein, 2596 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHERKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKMASSSNSFK

SEQ ID NO: 1027446 - protein, 932 aa, Homo sapiens
MRTRDEERHYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 1027447 - protein, 2644 aa, Homo sapiens; identical to SEQ ID NO: 1027444

SEQ ID NO: 1027448 - protein, 2644 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHERKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 1027449 - protein, 593 aa, Homo sapiens [sequence omitted]

SEQ ID NO: 1027450 - protein, 1678 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHERKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQV

SEQ ID NO: 1027451 - protein, 2626 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHERKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGGLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 1027452 - protein, 2596 aa, Homo sapiens; identical to SEQ ID NO: 1027445

SEQ ID NO: 1027453 - protein, 2596 aa, Homo sapiens; identical to SEQ ID NO: 1027445

SEQ ID NO: 1027454 - protein, 2644 aa, Homo sapiens; identical to SEQ ID NO: 1027444

SEQ ID NO: 1027455 - protein, 246 aa, Homo sapiens
WTQKLARGTETAIERFSDLSSGTTIMTHGHFAQEPTDWTTSNTEMCEVGQVCQETLLLLDVELTSTLVGTKGCSTVGAQNSQKTTIHSAPPGVLVASYTHFCSITAVAANASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGGAEGLESLTWGVGLALAPALWWGVVCPSC

SEQ ID NO: 1027456 - protein, 246 aa, Homo sapiens; identical to SEQ ID NO: 1027455

SEQ ID NO: 1027457 - protein, 149 aa, Homo sapiens [sequence omitted]

SEQ ID NO: 1027458 - protein, 214 aa, Homo sapiens
MVLGGCPVSYLLLCGQAALLLGNLLLLHCVSRSHSQNATAEPELTSAGAAQPEGPGGAASWEYGDPHSPVILCSYLPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 1027459 - protein, 214 aa, Homo sapiens; identical to SEQ ID NO: 1027458

SEQ ID NO: 1027460 - protein, 159 aa, Homo sapiens [sequence omitted]

SEQ ID NO: 1027461 - protein, 193 aa, Homo sapiens
MVLGGCPVSYLLLCGQAALLLGNLLLLHCVSRSHSQNATAEPELTSAGVILCSYLPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 1027462 - protein, 103 aa, Homo sapiens
MVLGGCPVSYLLLCGQAALLLGNLLLLHCVSRSHSQNATAEPELTSAGAAQPEGPGGAASWEYGDPHSPVILCSYLELPVVEAVTWRVSRIYGFKGGRLGHAA

SEQ ID NO: 1027463 - protein, 159 aa, Homo sapiens [sequence omitted]

SEQ ID NO: 1027464 - protein, 159 aa, Homo sapiens [sequence omitted]

SEQ ID NO: 1027465 - protein, 214 aa, Homo sapiens; identical to SEQ ID NO: 1027458

SEQ ID NO: 1027466 - protein, 214 aa, Homo sapiens; identical to SEQ ID NO: 1027458

SEQ ID NO: 1027467 - protein, 214 aa, Homo sapiens; identical to SEQ ID NO: 1027458

SEQ ID NO: 1027468 - protein, 159 aa, Homo sapiens
VLEDPRRLSSSPGDGRPGREQRLRLRWLPGGQFQAQALRNASNPGYLVTVSAGFRESPIGVWGFGNTFQNTFPFFHKAKRSGRPFFERNSILRVCLENTLLGVHVGSGHSGQEAVALRPAATRRRQTQAMTWFIMRGARVDSVLGSRWRQNCRGFLPVP

SEQ ID NO: 1027469 - protein, 254 aa, Homo sapiens
ISSCTTRKMAEQEQRKIPLVPENLLKKRKAYQALKATQAKQALLAKKEQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWGFPNLKSVRELILKRGQAKVKNKTIPLTDNTVIEEHLGKFGVICLEDLIHEIAFPGKHFQEISWFLCPFHLSVARHATKNRVGFLKEMGTPGYRGERINQLIRQLN

SEQ ID NO: 1027470 - protein, 105 aa, Homo sapiens
ISSCTTRKMAEQEQRKIPLVPENLLKKRKAYQALKATQAKQALLAKKEQKKGKGLRFKRLESFLHDSWRQKRDKVRLRRLEVKPHALELPDKHSLAFVVRIEDYA

SEQ ID NO: 1027471 - protein, 300 aa, Homo sapiens
MCPQPEEGSTDRPPRGTLHSSAGHFTCFLLAVVRLDTDSTDRHIEFQKHEGMSERERQVMKKLKEVVDKQRDEIRAKDRKLGLKNEDVEALQQQQTRLMKINHDLRHRVTVVEAQGKALIEQKVELEADLQTKEQEMGSLRAELGKLRERLQGEHSQNGEEEPETEPVGEESISDAEKVAMDLKDPNRPRFTLQELRDVLHERNELKSKVFLLQEELAYYKSEEMEEENRIPQPPPIAHPRTSPQPESGIKRLFSFFSRDKKRLANTQRNVHIQESFGQWANTHRDDGYTEQGQEALQHL

SEQ ID NO: 1027472 - protein, 79 aa, Homo sapiens
MSVHSGTFNWQLTPQILKTGLDSRFIMSIDGSLARSTGSTVPPIKINSFVMISTISQNLSWGAGMDAKEGSVLAVVVGG

SEQ ID NO: 1027473 - protein, 297 aa, Homo sapiens
LGARHWNPPAQACQAPQQQRGQKTKQFMPTLSQRDVNFSEEEFQKHKGMSERERQVMKKLKEVVDKQRDEIRAKDRKLGLKNEDVEALQQQQTRLMKINHDLRHRVTVVEAQGKALIEQKVELEADLQTKEQEMGSLRAELGKLRERLQGEHSQNGEEEPETEPVGEESISDAEKVAMDLKDPNRPRFTLQELRDVLHERNELKSKVFLLQEELAYYKSEEMEEENRIPQPPPIAHPRTSPQPESGIKRLFSFFSRDKKRLANTQRNVHIQESFGQWANTHRDDGYTEQGQEALQHL

SEQ ID NO: 1027474 - protein, 300 aa, Homo sapiens; identical to SEQ ID NO: 1027471

SEQ ID NO: 1027475 - protein, 67 aa, Homo sapiens
AESAADHMLRTVYRADIFGLSEECRHWCHRDLVWILYTRYVIMKRVNLHPIKTNHNNLKTNDNHTQH

SEQ ID NO: 1027476 - protein, 67 aa, Homo sapiens; identical to SEQ ID NO: 1027475

SEQ ID NO: 1027477 - protein, 293 aa, Homo sapiens
MTTVSTTHLHTLQHSPLNTNTPTHNTHNTHNTTTAQTPKRGETASPYRLSHHQRAQQSNKKKPREDIQTTKKRRATTQPPTHNTKSTQQHRARPDTIPPATLPAHTRDRHTRNHHRQHPHTRRDRKTQNTQRDEEHNHKVRQPPHPQKTPNATEGEPEPFPPPYQARDTRDNQTDRAHHTPTRKPPRNNHPTTLHHKRNGVNHAPPPAPRPTKPLRSPDTNAAARPPQPPRRRREQANTGRRRQPKHQESKTRSTTSDSKSTRTGDEAEEQLTGSERQPGQKPAHHRNQNHTG

SEQ ID NO: 1027478 - protein, 67 aa, Homo sapiens; identical to SEQ ID NO: 1027475

SEQ ID NO: 1027479 - protein, 67 aa, Homo sapiens; identical to SEQ ID NO: 1027475

SEQ ID NO: 1027480 - protein, 67 aa, Homo sapiens; identical to SEQ ID NO: 1027475

SEQ ID NO: 1027481 - protein, 67 aa, Homo sapiens; identical to SEQ ID NO: 1027475

SEQ ID NO: 1027482 - protein, 67 aa, Homo sapiens; identical to SEQ ID NO: 1027475

SEQ ID NO: 1027483 - protein, 165 aa, Homo sapiens
MALEKSLVRLLLLVLILLVLGWVQPSLGKESRAKKFQRQHMDSDSSPSSSSTYCNQMMRRRNMTQGRCKPVTTFVHKPWENVQMVCFQKRVTGRTGQGTVFRTTSGCAYQNVPCENGSRSPTVCIRHQPKGNTFMWAVKGTGTRFGDPALNLEIVRIACSVGKCD

SEQ ID NO: 1027484 - protein, 93 aa, Homo sapiens
MALEKSLVRLLLLVLILLVLGWVQPSLGKESRAKKFQRQHMDSDSSPSSSSTYCNQMMRRRNMTQGRCKSSGHHSVHERVSRGPEEGTVRDVI

SEQ ID NO: 1027485 - protein, 100 aa, Homo sapiens
MALEKSLVRLLLLVLILLVLGWVQPSLGKESRAKKFQRQHMDSDSSPSSSSTYCNQMMRRRNMTQGRCKTLNSFVHETLVDVPNVCFQGKVFGKIGQGHR

SEQ ID NO: 1027486 - protein, 106 aa, Homo sapiens
MALEKSLVRLLLLVLILLVLGWVQPSLGKESRAKKFQRQHMDSDSSPSSSSTYCNQMMRRRNMTQGRCNQWTPCARALVDVRCLFRKVTARRQALYKRLSMNHRMP

SEQ ID NO: 1027487 - protein, 194 aa, Homo sapiens
TEQGVVLEGSVSDFVFLEALNQGVIRKQCVDHYNEVKSVTVCDYLPPPPGIDVPVPEVQRRIQKKDPHEMKITSALQINAYKKTFLPKMSEKCEVLQYSARAQYSKKVVEDIEYLKFDKGPWLKQDNRTLYHLRLLVQDKFEVLNNTSIPIFLPEVTIGAHQTDRVLHQFRELPGRKYSPGYNTEVGDKWIWLK

SEQ ID NO: 1027488 - protein, 194 aa, Homo sapiens; identical to SEQ ID NO: 1027487

SEQ ID NO: 1027489 - protein, 194 aa, Homo sapiens; identical to SEQ ID NO: 1027487

SEQ ID NO: 1027490 - protein, 194 aa, Homo sapiens; identical to SEQ ID NO: 1027487

SEQ ID NO: 1027491 - protein, 194 aa, Homo sapiens; identical to SEQ ID NO: 1027487

SEQ ID NO: 1027492 - protein, 194 aa, Homo sapiens; identical to SEQ ID NO: 1027487

SEQ ID NO: 1027493 - protein, 2611 aa, Homo sapiens
MKWHLLIQEQRGEAELLKTARHPPCLHSNPGAGATFFAFIYPQIRGDRQEVLMAVPAIIANPFASLCIDLNSDFVNFQGVGNIIEFSEWAWLILCKLKVMGHKNSKSGTSFKKESTLRASIGWELFSMPRLAALRTAGTACCYKKEIDSAALGALTDYDCWEIPRTLNARANLSMCSETSGGSVILWLCVVLIMVQCGHEMKTPKWAYRYDMFEMFVFNKNILTLFGNGNRKIAKWILTLRKDEQVTCSKAGGCELPLSEGIPSSTFSLLVRTTRRHPPGPPALHCLSSLLNNSSLSSNMYKKKSLLYKFANKEIFFKSPQYILPVTIVMGTFAFGRFLLYAWDKYIFKQKWDYAIKFYFVTLIYSEQPFLMMTGCSLAWLYQFKQSCFNGHYRVFSSFFFLLENNTCDDFPCSSDFFNVCCYLFGNAEYIHFEKEMTVKLLRLQVHIAKLPSREEIFSISVLTGEANLMPSPLPQNRLYHIENLCSSDGIESAFPVDVSIALSAGDWTSLPCVNWPFVVCVCVRVCVCVCVYDFLIPSHFSIDCFAKAIYILRILIIFCYICCKYFFPVYRLPFNFVFQVDKSKTIFLGEFITVVSELVMCRSFPPQEYININPYFLMELVWFRFLHLNLLPRGVCCGICVCVRRGMVLQNPPPVAREPCPVRVVITVAGFNSEDLEGRLMFPEWAPGCCLSLTLHFPILSGFGPNRALELVRILTGLLGNFMSGSKLLNLPKPVSVKMRVNECEMFGSSYSLLSSHSELSCLCPPSPPPLVPSVRSSHFLLGPSPFSVAGCLPAWRWTFHVTGISMYILVWSVSTLNFVSSSISLYRQSSQTHLKRLFLRILNLPKGSPMDGFLEVYKCSEIVFFCGKHNFHLLVRAQKRSGMNDCMILCHCAYTKGYVAHLLSCETVLTTLNRAAVSISVNLVYTCIPWSGINSAVSTYGFITLFTDSNDSRKLHFLLGVYDDPFPYIATNIRFLQFYLFLATLRNFCGEIHIIEVDYAESFLSIHSVVLSMSPLLYNQSPELFHLAKQTLYPLNNIKHSIPSSLSNPISTFCFCEFDYSKHFISVKIMKYLSVCDWLISLSTVSSRCVYVVAYVRISFLFKRSKEYSYFISFFYPFIHEWTLGLLLAIVNNGAMYKYLYYCIYKYNAVMYTHLFEILTFSSFEYIARSGITKSYDISIFNLLRNHCEFFIATAPFYVLTKSAQGFRGSHILPNTCYFLLFLDCSHHSGCEVTFHCGFDLHFPNEEDAEHLFICLLVICMLSLEKCLFKSFDYFKNWVIRVIVVVDLEEFLSIFWILIPYQIYDLQISSLIPQGYFFTLLIVFFDDIEVFSFEIVYIYLFLLLWSVLLVSYPRNPCQIQRYKVLLRYFSCLQSIFLYSPFFIHSSVDGHVGWFHIFAILNCAVIRCLFSIMIYSPLRRYPVVEIAGSNGFYNFLFYHSFSLHFSSLTTNHVKFYIDLYNDHELLVSLGRPHLPLMIVNLILHFSCYCWCKKHLLYQDFKNQSDKSLISLIIITDKSIEFASDYFFFSSYTCMYSYDYNEHSSPFKLIIYIDEISKMLMTKYCLGFFVPGQSILTSYNFLFFLYVCVCVYFFFFNFNGFGVQMAFGHIDEFYSSEVCRFYCTGHLSSVHCTQYVVFYTLPPSYPPHFESLVSIMSLCIPFCTHKLALTYKGEHTVFGFPFLSCFTENNILQLHPKLLQKKKKPQTLFCSFLLLSHIPWCRDTTFYLSTHWLMGWFHIFAIVTCTAIKCLSGIMTSFPLGRYPGVGLLDQMVLNIFSLDLFLEILAPVFVVVVNKMQWNVMIITFHYALKSGKWRLEHSCKARIFSLLELKYTELGKSQSYIFDSGHNMALFYLLSLIVFNNVVSISESPIQYKNKDNTDSNSYGYNEHSSPLKLIIYTDEIEIENFNELNTVFDFLFQVCQYELLIIFFFFLYVCVCVYIYIYLISMAFGVQMAFGHIYEFYSSEDLRFYYTFHLCGPTPPASPAASCHPLGQGNNHPESWVYLSLAFFSYNFAKESDLNVFFRVYIYILAVLRENLLFCMSSYGTFSFNTMVRFSPCPGDSSFSLFTGYSSSCDYTSVSLSVLPSMVTRLPLSLSTTLFLSVLVEDDMWVFSPYTELKGDDNNVGTTNPPPSRGVTSVYQFAVFPATPRLIHFHLYLKNVLHGFFSIEVVKCYCVLYIIDYFFSFNSREMPGSTQRTALIVFNFCLYVCEFSHSAVNGNLQYSESFDITNSSVRSSSYTTPCAQCMSVSQGRYQEVKFLGHQGVSPTFFSILPCCPPEWVSSFAYLSMRVSVVHILYDAPYMKLKFLLVAIFDLSCMQGPTKTVIGTVDSCHLCVNLAFMGLMLTRPPGSKTYESCIILSRYNFLNCFCHVSAGDAQPSALHPGHTVALSSAYACIAATVLKDQNYADLGKSMANVIILCAIVMDGAVEMYEFINHWSCNENSNTIEKGHVEDKSSSIIPDPKITTNDNFIYIPSDIFWLWMYKMYPIILCPKMESYKVYCYFYGSITCHIVRVGMVILTIFLVMALRYLQFPSHLKVCCGDLFCIPLGAELRHPEAVSRGGSICRCLHLLWLLAHLVGDTVFVRWVESTCCQNRIMLVLSSCAVELG

SEQ ID NO: 1027494 - protein, 2563 aa, Homo sapiens
MRQEVLMAVPAIIANPFASLCIDLNSDFVNFQGVGNIIEFSEWAWLILCKLKVMGHKNSKSGTSFKKESTLRASIGWELFSMPRLAALRTAGTACCYKKEIDSAALGALTDYDCWEIPRTLNARANLSMCSETSGGSVILWLCVVLIMVQCGHEMKTPKWAYRYDMFEMFVFNKNILTLFGNGNRKIAKGILTLRKDEQVHVPRQVAVNFLWVKASPPAPFSLLVRTTRRHPPGPPALHCLSSLLNNSSLSSNMYKKKFTVKFANKEIFFKSPQYILPVTIVMGTFAFGRFLLYAWDKYIFKQKWDYAIKFYFVTLIYVNTFFNDDRMFPCMAVSIKTILFQWAYRVFSSFFFLLENNTCDDFPCSSDFFNVCCYLFGNAEYIHFEKEMTVKLLRLQVHIAKLPSREGFFQISVLTGEANLMPSPLPQNRLYHIENLCSSDGIESAFPVDVSIALSAGDWTSLPCVNWPFVVCVCVRVCVCVCVYDFLIPSHFSIDCFAKAIYILRILIIFCYICCKYFFPVYRLPFNFVFQVDKSKTIFLGEFITVVSELVMCRSFPPQEYININPYFLMELVWFRFLHLNLLPRGVCCGICVCVRRGMVLQNPPPVAREPCPVRVVITVAGFNSEDLEGRLMFPEWAPGCCLSLTLHFPILSGFGPNRALELVRILTGLLGNFMSGSKLLNLPKPVSVKMRVNECEMFGSSYSLLSSHSELSCLCPPSPPPLVPSVRSSHFLLGPSPFSVAGCLPAWRWTFHVTGISMYILVWSVSTLNFVSSSISLYRQSSQTHLKRLFLRILNLPKGSPMDGFLEVYKCSEIVFFCGKHNFHLLVRAQKRSGMNDCMILCHCAYTKGYVAHLLSCETVLTTLNRAAVSISVNLVYTCIPWSGIYLGSEHLWFYNISSQTQMTPESYTSCCEYMISISLHSHYTSGFYNYYLFLATLRNFCGEIHIIEVDYAESFLSIHSVVLSMSPLLYNQSPELFHLAKQTLYPLNNIKHSIPSSLSNPISTFCFCEFDYSKHFISVEIMKYLSVCDWLISLSTVSSRCVYVVAYVRISFLFKKIQIIFLFYIFFLSIHPLVDTWVAFGFVNNGAMYKYLYYCIYKYNAVMYTHLFEILTFSSFEYIARSGITKSYDISIFNLLRNHCEFFIATAPFYVLTKSAQGFRGSHILPNTCYFLLFLDCSHHSGCEVTFHCGFDLHFPNEEDAEHLFICLLVICMLSLEKCLFKSFDYFKNWVIRVIVVVDLEEFLSIFWILIPYQIYDLQISSLIPQGYFFTLLIVFFDVKKFLVLKKSNLSVFTFVVCAFGVISKKSLPNPTYKVLLRYFSCLQSIFLYSPFFIHSSVDGHVGWFHIFAILNCAVIRCLFSIMIYSPLRRYPVVEIAGSNGFYNFLFYHSFSLHFSSLTTNHVKFYIDLYNDHELLVSLGRPHLPLMIVNLILHFSCYCWCKKHLLYQDFKNQSDKSLISLIIITDKSIEFASDYFFFSSYTCMYSYDYNEHSSPFKLIIYIDEISKMLMTKYCLGFFVPGQSILTSYNFLFFLYVCVCVYFFFFNFNGFGVQMAFGHIDEFYSSEDLRFYCTGHLSSVHCTQYVVFYTLPPSYPPHFESLVSIMSLCIPFCTHKLALTYKGEHTVFGFPFLSCFTENNILQLHPKLLQKKKKPQTLFCSFLLLSHIPWCRDTTFYLSTHWLMGWFHIFAIVTCTAIKCLSGIMTSFPLGRYPGVGLLDQMVLNIFSLDLFLEILAPVFVVVVNKMQWNVMIITFHYALKSGKWRLEHSCKARIFSLLELKYTELGKSQSYIFDSGHNMALFYLLSLIVFNNVVSISESPIQYKNKDNTDSNSYGYNEHSSPLKLIIYTDEIEIENFNDLNTVFDFLFQVCQYELLIIFFFFLYVCVCVYIYIYLISMAFGVQMAFGHIYEFYSSEDLRFYYTFHLCGPTPPASPAASCHPLGQGNNHPESWVYLSLAFFSYNFAKESDLNVFFRVYIYILAVLRENLLFCMSSYGTFSFNTMVRFSPCPGDSSFSLFTGESSSCDYTSVSLSVLPSMVTRLPLSLSTTLFLSVLVEDDMWVFSPYTELKGDDNNVGTTNPPPSRGVTSVYQFAVFPATPRLIHFHLYLKNVLHGFFSIEVVKCYCVLYIIDYFFSFNSREMPGSTQRTALIVFNFCLYVCEFSHSAVNGNLQYSESFDITNSSVRSSSYTTPCAQCMSVSQGRYQEVKFLGHEGVSPTFFSILPCCPPEWVSSFAYLSMRVSVVHILYDAPYMKLKFLLVAIFDLSCMQGPTKTVIGTVDSCHLCVNLAFMGLMLTRPPGSKTYESCIILSRYNFLNCFCHVSAGDAQPSALHPGHTVALSSAYACIAATVLKDQNYADLGKSMANVIILCAIVMDGAVEMYEFINHWSCNENSNTIEKGHVEDKSSSIIPDPKITTNDNFIYIPSDIFWLWMYKMYPIILCPKMESYKVYCYFYGSITCHIVRVGMVILTIFLVMALRLFAVSSHLKVCCGDLFCIPLGAELRHPEAVSRGGSICRCLHLLWLLAHLVGDTVLVRWVESTCCQNRIMLVLSSCAVELG

SEQ ID NO: 1027495 - protein, 2472 aa, Homo sapiens
MTTRRHPPGPPALHCLSSLLNNSSLSSNMYKKKKFTVKFANKEIFFKSPQYILPVTIVMGTFAFGRFLLYAWDKYIFKQKWDYAIKFYFVTLIYVNTFFNDDRMFPCMAVSIKTILFQWAYRVFSSFFFLLENNTCDDFPCSSDFFNVCCYLFGNAEYIHFEKEMTVKLLRLQVHIAKLPSREEIFSISVLTGEANLMPSPLPQNRLYHIENLCSSDGIESAFPVDVSIALSAGDWTSLPCVNWPFVVCVCVRVCVCVCVYDFLIPSHFSIDCFAKAIYILRILKSFVIFDANIFFQFIELPFNFVFQVDKSKTIFLGEFITVVSELVMCRSFPPQEYININPYFLMELVWFRFLHLNLLPRGVCCGICVCVRRGMVLQNPPPVAREPCPVRVVITVAGFNSEDLEGRLMFPEWAPGCCLSLTLHFPILSGFGPNRALELVRILTGLLGNFMSGSKLLNLPKPVSVKMRVNECEMFGSSYSLLSSHSELSCLCPPSPPPLVPSVRSSHFLLGPSPFSVAGCLPAWRWTFHVTGISMYILVWSVSTLNFVSSSISLYRQSSQTHLKRLFLRILNLPKGSPMDGFLEVYKCSEIVFFCGKHNFHLLVRAQKRSGMNDCMILCHCAYTKGYVAHLLSCETVLTTLNRAAVSISVNLVYTCIPWSGIYLGSEHLWFYNISSQTQMTPESYTSCCEYMISISLHSHYTSGFYNYYLFLATLRNFCGEIHIIEVDYAESFLSIHSVVLSMSPLLYNQSPELFHLAKQTLYPLNNIKHSIPSSLSNPISTFCFCEFDYSKHFISVEIMKYLSVCDWLISLSTVSSRCVYVVAYVRISFLFKKIQIIFLFYIFFLSIHPLVDTWVAFGFVNNGAMYKYLYYCIYKYNAVMYTHLFEILTFSSFEYIARSGITKSYDISIFNLLRNHCEFFIATAPFYVLTKSAQGFRGSHILPNTCYFLLFLDCSHHSGCEVTFHCGFDLHFPNEEDAEHLFICLLVICMLSLEKCLFKSFDYFKNWVIRVIVVVDLEEFLSIFWILIPYQIYDLQISSLIPQGYFFTLLIVFFDDIEVFSFEIRLIYLFLLLWSVLLVSYPRNPCQIQRYKVLLRYFSCLQSIFLYSPFFIHSSVDGHVGWFHIFAILNCAVIRCLFSIMIYSPLRRYPVVEIAGSNGFYNFLFYHSFSLHFSSLTTNHVKFYIDLYNDHELLVSLGRPHLPLMIVNLILHFSCYCWCKKHLLYQDFKNQSDKSLISLIIITDKSIEFASDYFFFSSYTCMYSYDYNEHSSPFKLIIYIDEISKMLMTKYCLGFFVPGQSILTSYNFLFFLYVCVCVYFFFFNFNGFGVQMAFGHIDEFYSSEDLRFYCTGHLSSVHCTQYVVFYTLPPSYPPHFESLVSIMSLCIPFCTHKLALTYKLRTHSIWFSIPELLHLENILQLHPKLLQKKKKPQTLFCSFLLLSHIPWCRDTTFYLSTHWLMGWFHIFAIVTCTAIKCLSGIMTSFPLGRYPGVGLLDQMVLNIFSLDLFLEILAPVFVVVVNKMQWNVMIITFHYALKSGKWRLEHSCKARIFSLLELKYTELGKSQSYIFDSGHNMALFYLLSLIVFNNVVSISESPIQYKNKDNTDSNSYGYNEHSSPLKLIIYTDEIEIENFNDYNTVFDFLFQVCQYELLIIFFFFLYVCVCVYIYIYLISMAFGVQMAFGHIYEFYSSEDLRFYYTFHLCGPTPPASPAASCHPLGQGNNHPESWVYLSLAFFSYNFAKESDLNVFFRVYIYILAVLRENLLFCMSSYGTFSFNTMVRFSPCPGDSSFSLFTGESSSCDYTSVSLSVLPSMVTRLPLSLSTTLFLSVLVEDDMWVFSPYTELKGDDNNVGTTNPPPSRGVTSVYQFAVFPATPRLIHFHLYLKNVLHGFFSIEVVKCYCVLYIIDYFFSFNSREMPGSTQRTALIVFNFCLYVCEFSHSAVNGNLQYSESFDITNSSVRSSSYTTPCAQCMSVSQGRYQEVKFLGHEGVSPTFFSILPCCPPEWVSSFAYLSMRVSVVHILYDAPYMKLKFLLVAIFDLSCMQGPTKTVIGTVDSCHLCVNLAFMGLMLTRPPGSKTYESCIILSRYNFLNCFCHVSAGDAQPSALHPGHTVALSSAYACIAATVLKDQNYADLGKSMANVIILCAIVMDGAVEMYEFINHWSCNENSNTIEKGHVEDKSSSIIPDPKITTNDNFIYIPSDIFWLWMYKMYPIILCPKMESYKVYCYFYGSITCHIVRVGMVILTIFLVMALRYLQFPSHLKVCCGDLFCIPLGAELRHPEAVSRGGSICRCLHLLWLLAHLVGDTVLGDGLKARAAKIENVGPLLMCRGTGVKLRSGCSCLSIPGIEYNTVPGLAQNSSGSCRPQSLIPGILSPTQIKKTKNKLFYESVCDICKKWYLMIFYSLVCLVCGNLKWHPGLGRSAVCACPPLGTAWLLQGLSTHFLSSKGPPHARSSGVSPALALTS

SEQ ID NO: 1027496 - protein, 825 aa, Homo sapiens
MVSISESPIQYKNKDNTDSNSYGYNEHSSPLKLIIYTDEIEIENFNDYNTVFDFLFQVCQYELLIIFFFFLYVCVCVYIYIYLISMAFGVQMAFGHIYEFYSSEDLRFYYTFHLCGPTPPASPAASCHPLGQGNNHPESWVYLSLAFFSYNFAKESDLNVFFRVYIYILAVLRENLLFCMSSYGTFSFNTMVRFSPCPGDSSFSLFTGESSSCDYTSVSLSVLPSMVTRLPLSLSTTLFLSVLVEVIMWVFSPYTELKGDDNNVGTTNPPPSRGVTSVYQFAVFPATPRLIHFHLYLKNVLHGFFSIEVVKCYCVLYIIDYFFSFNSREMPGSTQRTALIVFNFCTDVCEFSHSAVNGNLQYSESFDITNSSVRSSSYTTPCAQCMSVSQGRYQEVKFLGHEGVSPTFFSILPCCPPEWVSSFAYLSMRVSVVHILYDAPYMKLKFLLVAIFDLSCMQGPTKTVIGTVDSCHLCVNLAFMGLMLTRPPGSKTYESCIILSRYNFLNCFCHVSAGDAQPSALHPGHTVALSSAYACIAATVLKRPKLCRFRKSMANVIILCAIVMDGAVEMYEFINHWSCNENSNTIEKGHVEDKSSSIIPDPKITTNDNFIYIPSDIFWLWMYKMYPIILCPKMESYKVYCYFYGSITCHIVRVGMVILTIFLVMALRYLQFPSHLKVCCGDLFCIPLGAELRHPEAVSRGGSICRCLHLLWLLAHLVGDTVLGDGLKARAAKIENVGPLLMCRGTGVKLRSGCSCLSIPGIEYNTVPGLAQNSSGSCRPQSLIPGILSPTQIKKTKNKLFYESVCDICKKWYLMIFYSLVCLVC

SEQ ID NO: 1027497 - protein, 2485 aa, Homo sapiens
MTFLVAQTFSVCCYLFGNAEYIHFEKEMTVKLLRLQVHIAKLPSREGFFQISVLTGEANLMPSPLPQNRLYHIENLCSSDGIESAFPVDVSIALSAGDWTSLPCVNWPFVVCVCVRVCVCVCVYDFLIPSHFSIDCFAKAIYILRILIIFCYICCKYFFPVYRLPFNFVFQVDKSKTIFLGEFITVVSELVMCRSFPPQEYININPYFLMELVWFRFLHLNLLPRGVCCGICVCVRRGMVLQNPPPVAREPCPVRVVITVAGFNSEDLEGRLMFPEWAPGCCLSLTLHFPILSGFGPNRALELVRILTGLLGNFMSGSKLLNLPKPVSVKMRVNECEMFGSSYSLLSSHSELSCLCPPSPPPLVPSVRSSHFLLGPSPFSVAGCLPAWRWTFHVTGISMYILVWSVSTLNFVSSSISLYRQSSQTHLKRLFLRILNLPKGSPMDGFLEVYKCSEIVFFCGKHNFHLLVRAQKRSGMNDCMILCHCAYTKGYVAHLLSCETVLTTLNRAAVSISVNLVYTCIPWSGIYLGSEHLWFYNISSQTQMTPESYTSCCEYMISISLHSHYTSGFYNYYLFLATLRNFCGEIHIIEVDYLKSFLSIHSVVLSMSPLLYNQSPELFHLAKQTLYPLNNIKHSIPSSLSNPISTFCFCEFDYSKHFISVEIMKYLSVCDWLISLSTVSSRCVYVVAYVRISFLFKKIQIIFLFYIFFLSIHPLVDTWVAFGFVNNGAMYKYLYYCIYKYNAVMYTHLFEILTFSSFEYIARSGITKSYDISIFNLLRNHCEFFIATAPFYVLTKSAQGFRGSHILPNTCYFLLFLDCSHHSGCEVTFHCGFDLHFPNEEDAEHLFICLLVICMLSLEKCLFKSFDYFKNWVIRVIVVVDLEEFLSIFWILIPYQIYDLQISSLIPQGYFFTLLIVFFDDIEVFSFEIRLIYLFLLLWSVLLVSYPRNPCQIQRYKVLLRYFSCLQSIFLYSPFFIHSSVDGHVGWFHIFAILNCAVIRCLFSIMIYSPLRRYPVVEIAGSNGFYNFLFYHSFSLHFSSLTTNHVKFYIDLYNDHELLVSLGRPHLPLMIVNLILHFSCYCWCKKHLLYQDFKNQSDKSLISLIIITDKSIEFASDYFFFSSYTCMYSYDYNEHSSPFKLIIYIDEISKMLMTKYCLGFFVPGQSILTSYNFLFFLYVCVCVYFFFFNFKAFGVQMAFGHIDEFYSSEDLRFYCTGHLSSVHCTQYVVFYTLPPSYPPHFESLVSIMSLCIPFCTHKLALTYKLRTHSIWFSIPELLHLEKYPPAPSKIAAKKKKTTNIILFFFIAKSIPWCRDTTFYLSTHWLMGWFHIFAIVTCTAIKCLSGIMTSFPLGRYPGVGLLDQMVLNIFSLDLFLEILAPVFVVVVNKMQWNVMIITFHYALKSGKWRLEHSCKARIFSLLELKYTELGKSQSYIFDSGHNMALFYLLSLIVFYNVVSISESPIQYKNKDNTDSNSYGYNEHSSPLKLIIYTDEIEIENFNDYNTVFDFLFQVCQYELLIIFFFFLYVCVCVYIYIYLISMAFGVQMAFGHIYEFYSSEVCRFYYTFHLCGPTPPASPAASCHPLGQGNNHPESWVYLSLAFFSYNFAKESDLNVFFRVYIYILAVLRENLLFCMSSYGTFSFNTMVRFSPCPGDSSFSLFTGESSSCDYTSVSLSVLPSMVTRLPLSLSTTLFLSVLVEDDMWVFSPYTELKGDDNNVGTTNPPPSRGGNQCYQFAVFPATPRLIHFHLYLKNVLHGFFSIEVVKCYCVLYIIDYFFSFNSREMPGSTQRTALIVFNFCLYVCEFSHSAVNGNLQYSESFDITNSSVRSSSYTTPCAQCMSVSQGRYQEVKFLGHEGVSPTFFSILPCCPPEWVSSFAYLSMRVSVVHILYDAPYMKLKFLLVAIFDLSCMQCPTKTVIGTVDSCHLCVNLAFMGLMLTRPPGSKTYESCIILSRYNFLNCFCHVSAGDAQPSALHPGHTVALSSAYACIAATVLKRPKLCRFRKSMANVIILCAIVMDGAVEMYEFINHWSCNENSNTIEKGHVEDKSSSIIPDPKITTNDNFIYIPSDIFWLWMYKMYPIILCPKMESYKVYCYFYGSITCHIVRVGMVILTIFLVMALRYLQFPSHLKVCCGDLFCIPLGAELRHPEAVSRGGSICRCLHLLWLLAHLVGDTVLGDGLKARAAKIENVGPLLMCRGTGVKLRSGCSCLSIPGIEYNTVPGLAQNSSGSCRPQSLIPGILSPHRLNKPKTNYSRKASVTFEKVVFNDLLFTCLFSLLKSSVASWSGKECCLRLPSAGHSVAASGAKHTLSVFYRAATCQELRCEPGSGSYLIGSLIGAQGAEHCTQRGTTRLGICLGGLTTSRRKYLSSSGLSSRVTGVLSLLLFCQGDNCVTHHLCVKARPCLGLCSCADPKGKCFASFLPVNFTYEEMCENCSKPYLHMFELQTLWVIQWHLSLTPSLPSHRGHRHGQLLQFLSREPVYV

SEQ ID NO: 1027498 - protein, 419 aa, Homo sapiens
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLKLYPPGDEEEAELADSSGLYHEGSPSPGSPWKTKLRTKDKEEKKKTEFLDLDNSPLSPPSPRTKSRTHTRALKKLSEVNKRLQDLRSCLSPKPPQGQEQQGQEDEVVLVEGPTLPETPRLFPLKIRCRADLVRLPLRMSEPLQSVVDHMATHLGVSPSRILLLFGETELSPTATPRTLKLGVADIIDCVVLTSSPEATETSQQLQLRVQGKEKHQTLEVSLSRDSPLKTLMSHYEEAMGLSGRKLSFFFDGTKLSGRELPADLGMESGDLIEVWG

SEQ ID NO: 1027499 - protein, 419 aa, Homo sapiens; identical to SEQ ID NO: 1027498

SEQ ID NO: 1027500 - protein, 455 aa, Homo sapiens
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLSSWDYSCVLLCLANYVEIGSPHLAQPGLGLLGSSDPPGSASKSAGITGVSHCVRLCLIVQGSDFKDLWGQSLSIALRPAVSCFYRDLDNSPLSPPSPRTKSRTHTRALKKLSEVNKRLQDLRSCLSPKPPQGQEQQGQEDEVVLVEGPTLPETPRLFPLKIRCRADLVRLPLRMSEPLQSVVDHMATHLGVSPSRILLLFGETELSPTATPRTLKLGVADIIDCVVLTSSPEATETSQQLQLRVQGKEKHQTLEVSLSRDSPLKTLMSHYEEAMGLSGRKLSFFFDGTKLSGRELPADLGMESGDLIEVWG

SEQ ID NO: 1027501 - protein, 419 aa, Homo sapiens; identical to SEQ ID NO: 1027498

SEQ ID NO: 1027502 - protein, 401 aa, Homo sapiens
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLKLYPPGDEEEAELADSSGLYHEGSPSPGSPWKTKLRTKDKEEKKKTEFLDLDNSPLSPPSPRTKSRTHTRALKKLSEVNKRLQDLRSCLSPKPPQGQEQQGQEDEVVLVEGPTLPETPRLFPLKIRCRADLVRLPLRMSEPLQSVVDHMATHLGVSPSRILLLFGETELSPTATPRTLKLGVADIIDCVVLTSSPEATETSQQLQLRVQGKEKHQTLEVSLSRDSPLKTLMSHAKILWFYGFFPFLYTILSHKHPCL

SEQ ID NO: 1027503 - protein, 419 aa, Homo sapiens; identical to SEQ ID NO: 1027498

SEQ ID NO: 1027504 - protein, 285 aa, Homo sapiens
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLKLYPPGDEEEAELADSSGLYHEGSPSPGSPWKTKLRTKDKEEKKKTEFLDLDNSPLSPPSPRTKSRTHTRALKKLSEVNKRLQDLRSCLSPKPPQGQEQQGQEDEVVLVEGPTLPETPRLFPLKIRCRADLVRLPLRMVSA

SEQ ID NO: 1027505 - protein, 285 aa, Homo sapiens; identical to SEQ ID NO: 1027504

SEQ ID NO: 1027506 - protein, 206 aa, Homo sapiens
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLSSWDYSCVLLCLANYVEIGSPHLAQPGLGLLGSSDPPGSASKSAGITGVSHCVRLCLIVQGI

SEQ ID NO: 1027507 - protein, 193 aa, Homo sapiens
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLKLYPPGDEEEAELADSSGLYHEGSPSPGSPWKTKLRTKDKEEKKKTEFL

SEQ ID NO: 1027508 - protein, 127 aa, Homo sapiens
MATHLGVSPSRILLLFGETELSPTATPRTLKLGVADIIDCVVLTSSPEATETSQQLQLRVQGKEKHQTLEVSLSRDSPLKTLMSHYEEAMGLSGRKLSFFFDGTKLSGRELPADLGMESGDLIEVWG

SEQ ID NO: 1027509 - protein, 419 aa, Homo sapiens; identical to SEQ ID NO: 1027498

SEQ ID NO: 1027510 - protein, 419 aa, Homo sapiens; identical to SEQ ID NO: 1027498

SEQ ID NO: 1027511 - protein, 285 aa, Homo sapiens; identical to SEQ ID NO: 1027504

SEQ ID NO: 1027512 - protein, 377 aa, Homo sapiens
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLSSWDYSCVLLCLANYVEIGSPHLAQPGLGLLGSSDPPGSASKKCWDYRCEPLRPTMLDCPRDLISRIVGPVSLHCPPSCCLLLLQGSGQLSSVPTFTKDQKQNAYSGTQEVKVPSAGALAGMEEGNLGGWLTPVDPESCLHCSEMVVSSRGVLAEGTVILFPSCSLELPIILFSLSCLHTFCFLCLHFPNAPLSFWQTFYPFFKAPHKHPVSFFFLQKVVLLCPGWFRTPGLK

SEQ ID NO: 1027513 - protein, 152 aa, Homo sapiens
TKRRRRSAEVTGKSQNSNTLAGAWGVKNRRRERDVFQALQRRIQGQPKLPGSQNQFFYQCSTHCCHFSLLGTGKCCSKGFDLRLQEEDAGRTAGVLGFYSIWARSYVSNKPKGEKYEPSSHPIGAAENPAGSSGNGLACPAGSGKFEKSICS

SEQ ID NO: 1027514 - protein, 503 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 1027515 - protein, 218 aa, Homo sapiens
REYIGSRRSSLWRRQPGWQLTGQPGSILLRVFSKSRAGLEARKLKAYRTMEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKVMREDDE

SEQ ID NO: 1027516 - protein, 107 aa, Homo sapiens
SRLKSIPQETRCIRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 1027517 - protein, 187 aa, Homo sapiens
REYIGSRRSSLWRRQPGWQLTGQPGSILLRVFSKSRAGLEARKLKAYRTMEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQS

SEQ ID NO: 1027518 - protein, 526 aa, Homo sapiens
REYIGSRRSSLWRRQPELKAYRTMEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 1027519 - protein, 552 aa, Homo sapiens
REYIGSRRSSLWRRQPGWQLTGQPGSILLRVFSKSRAGLEARKLKAYRTMEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 1027520 - protein, 218 aa, Homo sapiens; identical to SEQ ID NO: 1027515

SEQ ID NO: 1027521 - protein, 503 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVIECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 1027522 - protein, 564 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTSSPPPAPIYTPPPPAPHCPPPPPSAPTPPIPSPPSTLPPPPQAPPPNRAPPPSRPPPRPSV

SEQ ID NO: 1027523 - protein, 333 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSLHKIASGPTTAACME

SEQ ID NO: 1027524 - protein, 521 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTPPPNRAPPPSRPPPRPSV

SEQ ID NO: 1027525 - protein, 393 aa, Homo sapiens
GELVITDGFSGQPLSPVKAYIPLGSEYNYEPLSPNGFPKFSTSKPNQSPHVFVYLLCSQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTPPPNRAPPPSRPPPRPSV

SEQ ID NO: 1027526 - protein, 521 aa, Homo sapiens; identical to SEQ ID NO: 1027524

SEQ ID NO: 1027527 - protein, 521 aa, Homo sapiens; identical to SEQ ID NO: 1027524

SEQ ID NO: 1027528 - protein, 564 aa, Homo sapiens; identical to SEQ ID NO: 1027522

SEQ ID NO: 1027529 - protein, 347 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCDGLWFYIQSLETVKDHRNIRVRNSDLKYCL

SEQ ID NO: 1027530 - protein, 297 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLSKSLQSPWVSSTSGFKEGNSHPCLPARPHT

SEQ ID NO: 1027531 - protein, 521 aa, Homo sapiens; identical to SEQ ID NO: 1027524

SEQ ID NO: 1027532 - protein, 207 aa, Homo sapiens
QFSLLAEAISQEHQELKARTTNIGYLWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTPPPNRAPPPSRPPPRPSV

SEQ ID NO: 1027533 - protein, 83 aa, Homo sapiens
GCLEDPCIYSMALPRDSRGHSEVQAEMLTLLSNEMVSISANAPFSTSVICPVQLQDVVSAKHFDGIGNCKCMMILKRLSRICS

SEQ ID NO: 1027534 - protein, 521 aa, Homo sapiens; identical to SEQ ID NO: 1027524

SEQ ID NO: 1027535 - protein, 333 aa, Homo sapiens; identical to SEQ ID NO: 1027523

SEQ ID NO: 1027536 - protein, 248 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPLFHLPALLLPECPSSMATNMTLRPVGIQWCTSPASVTHSTTSSACWRRSSCTVSPMALCLCATSSRTGPTTGASPRGWAITSITLSKSPYLRSSAGETGARHLCDLQLGNFSIQMACGNWGRGSKKRKIHNPQEPFRGSPGVPAQNYKGG

SEQ ID NO: 1027537 - protein, 104 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQIILVRVFLTENSGAPVHLPC

SEQ ID NO: 1027538 - protein, 191 aa, Homo sapiens
HETQRPGLERPALQRIMVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGKLKAPAA

SEQ ID NO: 1027539 - protein, 342 aa, Homo sapiens
SDRDHCAYSPIVEMKEKMLEGSQRERSGYPQREAHQTKQRISRQKLYKPEESGGRYSTFLKKRIFNPEFHIQPNIKDTIGTAAPAAPTPHRRLHLHGHPCGGRLTTSHHIIPRAELLKRDDAVPTTLPSSSLFILSVSLVLSFPVFTFFLRDSKPSTTSVYPPVPSEFNLALSHLHMAGRVETALSLGCEVCVRCETTLASALTQGPDEPTILGRVTGRRLCDYEDITLTSTSLEAPNDITEQPYKRFHNAPSRLMMTRYHNKGLQAANAPGTVNPSTYNAAWVPKATQQTKQKTEGSRSAATNKRSPHKRDDRQETHTQKTPANNNGNKKGAPKQRAPRKC

SEQ ID NO: 1027540 - protein, 166 aa, Homo sapiens
MAGRVETALSLGCEVCVRCETTLASALTQGPDEPTILGRVTGRRLCDTEDITLTSTSLEAPNDITEQPYKRFHNAPSRLMMTRTTQGTSGSERPWDRQSIDIQRSLGTQGDTTNKTEDRGEQERSNKQKKSPQKGRPQETHTQKTPANNNGNKKGAPKQRAPRKCQ

SEQ ID NO: 1027541 - protein, 166 aa, Homo sapiens; identical to SEQ ID NO: 1027540

SEQ ID NO: 1027542 - protein, 342 aa, Homo sapiens
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 1027543 - protein, 291 aa, Homo sapiens; identical to SEQ ID NO: 886347

SEQ ID NO: 1027544 - protein, 228 aa, Homo sapiens
DHERLFRYGSQKGPARAFRASAVALCGPLRRCCPWAPPCSQPTASESAHSSAPGARGRGSSPGPSCGPRGGNNEDVSFSRPADLDLIQSTPFKPLALKTPPRVLTLSERPLDFLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 1027545 - protein, 342 aa, Homo sapiens; identical to SEQ ID NO: 1027542

SEQ ID NO: 1027546 - protein, 238 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 1027547 - protein, 264 aa, Homo sapiens
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 1027548 - protein, 291 aa, Homo sapiens; identical to SEQ ID NO: 886347

SEQ ID NO: 1027549 - protein, 316 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 1027550 - protein, 291 aa, Homo sapiens; identical to SEQ ID NO: 886347

SEQ ID NO: 1027551 - protein, 243 aa, Homo sapiens
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTYGISNIDTTIEGTSDDLTVVDAASLRRQIIKLNRRLQLLEEENKERAKREMVMYSITVAFWLLNSWLWFRR

SEQ ID NO: 1027552 - protein, 317 aa, Homo sapiens
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 1027553 - protein, 264 aa, Homo sapiens; identical to SEQ ID NO: 1027547

SEQ ID NO: 1027554 - protein, 249 aa, Homo sapiens
TSISGGRWSSTGTLLWSLGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 1027555 - protein, 269 aa, Homo sapiens
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTYGISNIDTTIEGTSDDLTVVDAASLRRQIIKLNRRLQLLEEENKERAKREMVMYSITVAFWLLNSWLWFRR

SEQ ID NO: 1027556 - protein, 238 aa, Homo sapiens; identical to SEQ ID NO: 1027546

SEQ ID NO: 1027557 - protein, 160 aa, Homo sapiens
DHERLFRYGSQKGPARAFRASAVALCGPLRRCCPWAPPCSQPTASESAHSSAPGARGRGSSPGPSCGPRGSGRDLQPELAARPIAAAETLRPTGTRGGPGPPGSVSLTRVPSPGLLPSTLVFPPPRDLESPRRARERSAFCRCYWANLFTLCGSASPLVY

SEQ ID NO: 1027558 - protein, 317 aa, Homo sapiens; identical to SEQ ID NO: 1027552

SEQ ID NO: 1027559 - protein, 297 aa, Homo sapiens
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRYGISNIDTTIEGTSDDLTVVDAASLRRQIIKLNRRLQLLEEENKERAKREMVMYSITVAFWLLNSWLWFRR

SEQ ID NO: 1027560 - protein, 316 aa, Homo sapiens; identical to SEQ ID NO: 1027549

SEQ ID NO: 1027561 - protein, 218 aa, Homo sapiens; identical to SEQ ID NO: 896326

SEQ ID NO: 1027562 - protein, 326 aa, Homo sapiens
DHERLFRYGSQKGPARAFRASAVALCGPLRRCCPWAPPCSQPTASESAHSSAPGARGRGSSPGPSCGPRGGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 1027563 - protein, 228 aa, Homo sapiens; identical to SEQ ID NO: 1027544

SEQ ID NO: 1027564 - protein, 244 aa, Homo sapiens
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 1027565 - protein, 81 aa, Homo sapiens
DHERLFRYGSQKGPARAFRASAVALCGPLRRCCPWAPPCSQPTASESAHSSAPGARGRGSSPGPSCGPRGTKVALNPAHAH

SEQ ID NO: 1027566 - protein, 218 aa, Homo sapiens; identical to SEQ ID NO: 896326

SEQ ID NO: 1027567 - protein, 147 aa, Homo sapiens
RKSFQKELVMALLKMDCQGLVVRLIQDFVLLTTAVEVAQRWRELAEKLAKVSKQQMDAYESPHRDRNGVVDSEAMWKPAYDFLLTWSHQIGDSYRDVIQELHLGLDKMKNPITKRWKHLTGTLILVNSLDVLRAAAFSPADQDDFVI

SEQ ID NO: 1027568 - protein, 147 aa, Homo sapiens; identical to SEQ ID NO: 1027567

SEQ ID NO: 1027569 - protein, 147 aa, Homo sapiens; identical to SEQ ID NO: 1027567

SEQ ID NO: 1027570 - protein, 147 aa, Homo sapiens; identical to SEQ ID NO: 1027567

SEQ ID NO: 1027571 - protein, 172 aa, Homo sapiens
MADGGGGGSGGAGPASTRASGGGGPINPASLPPGDPQLIAIIVGQLKSRGLFDSFRRDCKADVDTKPAYQNLSQKADNFVSTHLDKQEWNPPANDNQLHDGLRQSVVQSGRSEAGVDRISSQVVDPKLNHIFRPQIEQIIHEFLVAQKEAAVPALPPEPEGQDPPAPSQDTS

SEQ ID NO: 1027572 - protein, 172 aa, Homo sapiens; identical to SEQ ID NO: 1027571

SEQ ID NO: 1027573 - protein, 172 aa, Homo sapiens; identical to SEQ ID NO: 1027571

SEQ ID NO: 1027574 - protein, 241 aa, Homo sapiens
MSSLDPFCCNWLCCYHSLHPTAQNSKGCLNPAVNTQLGHFTSYLSFLSYKMGVAEVAFQCGVEGEMQEGTLSPQPRVLSSGKLTAPSPGLGFRIWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRRMQPCNCCDFNGQCFSTCCMRERYNAGPGLIG

SEQ ID NO: 1027575 - protein, 681 aa, Homo sapiens
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1027576 - protein, 729 aa, Homo sapiens
EREEGEELHKPRQGLESRQGLESRQGLESWPSSFSQLLCSSPSVGGEKGRTTSLPEAAAYSRGEASPAYSADTGQRGARFFALTNAESRPSEQPGWKCLSTVTRQIQDRMGSPVHRVSLGDTWSRQMHPDIESERYMQSFDVERLTNILDGGAQNTALRRKVDAMKQVGEKICRALSGDVALNIHRVFVRALRSLGSEEQIAKWDPLCNLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1027577 - protein, 593 aa, Homo sapiens
MTQNERYKAAMRRAFHIRLIARRLGWLEDGRELGYAYRALSGDVALNIHRVFVRALRSLGSEEQIAKWDPLCNLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1027578 - protein, 729 aa, Homo sapiens
EREEGEELHKPRQGLESRQGLESRQGLESWPSSFSQLLCSSPSVGGEKGRTTSLPEAAAYSRGEASPAYSADTGQRGARFFALTNAESRPSEQPGWKCLSTVTRQIQDRMGSPVHRVSLGDTWSRQMHPDIESERYMQSFDVERLTNILDGGAQNTALRRKVDPGSKWVRRFDLRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1027579 - protein, 790 aa, Homo sapiens
EREEGEELHKPRQGLESRQGLESRQGLESWPSSFSQLLCSSPSVGGEKGRTTSLPEAAAYSRGEASPAYSADTGQRGARFFALTNAESRPSEQPGWKCLSTVTRQIQDRMGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1027580 - protein, 301 aa, Homo sapiens
DLRAELGMSRCSVSGAQGWSLWWRPPNTAQPPSMFSQLHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIREIRCKAIQAKEMGKVDSVNLRIKEMEGCHPVN

SEQ ID NO: 1027581 - protein, 98 aa, Homo sapiens
WEGGVTQYHCWAIGIYICRVFFCLDPPCAGFLQTFSLARLCTRLKRVSESIDRPLLAGRSYTSDYTVKPAPPYYWVTGKCNLSGPSFPMQTGVLPLKS

SEQ ID NO: 1027582 - protein, 333 aa, Homo sapiens
DLRAELGMSRCSVSGAQGWSLWWRPPNTAQPPSMFSQLHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1027583 - protein, 801 aa, Homo sapiens
EREEGEELHKPRQGLESRQGLESRQGLESWPSSFSQLLCSSPSVGGEKGRTTSLPEAAAYSRGEASPAYSADTGQRGARFFALTNAESRPSEQPGWKCLSTVTRQIQDRMGSPVHRVSLGDTWSRQMHPDIESERYMQSFDVERLTNILDGGAQNTALRRKVDPGSKWVRRFEGARNLTQVPKPSVLLSSAESIIHSYPEFSCKDNYFMTQNERYKAAMRRAFHIRLIARRLGWLEDGRELGYAYRALSGDVALNIHRVFVRALRSLGSEEQIAKWDPLCNLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1027584 - protein, 370 aa, Homo sapiens
MGKVDTTGSDLNLLVLFLFSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 1027585 - protein, 758 aa, Homo sapiens
EREEGEELHKPRQGLESRQGLESRQGLESWPSSFSQLLCSSPSVGGEKGRTTSLPEAAAYSRGEASPAYSADTGQRGARFFALTNAESRPSEQPGWKCLSTVTRQIQDRMGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIREIRCKAIQAKEMGKVDSVNLRIKEMEGCHPVN

SEQ ID NO: 1027586 - protein, 681 aa, Homo sapiens; identical to SEQ ID NO: 1027575

SEQ ID NO: 1027587 - protein, 210 aa, Homo sapiens
TVLVELTPDIHICGCKQQFNNLDAFVAKQSGCKGSAAAPSTVQFVSEETVPATTPASLISETQTPVSAPEFVFAHGYQTSLPESNETQTATVLPAQSRKTPTTPPAQKRLNCCYPGCQFKTAYGMKDMGRHLKIHTGDPHKCEVCGKCFSRKDKLKTHMRCHTGVKPCPVEAVLRRRPHSSSLHKLGIHSDERPFKCQICLLRHPSNINH

SEQ ID NO: 1027588 - protein, 244 aa, Homo sapiens
VLAVLTDRNYTVTGEEPHVQLYITPLPAPPRHPSFQPRLTSSKPTASSGDPPRPTTAVTPQATSGLPPTATLRSTATKPTVTQATTTATASTCQPSHDVHSSVHNTDHNDTTNPSHIRDKPHAAKIDQSGTARNNGHPDDRPTSNPSKHHRPNHPTARTTHEAHMPQRPLKQERLLNTQHPKAQTSHTLRLRRGVPSLPQGPVTATSFHATTTYPTPAHPETTLPTSRSTFLHLLGDPSTHVGE

SEQ ID NO: 1027589 - protein, 670 aa, Homo sapiens
MEEFRRSYSRLCRESGAEPQEAVLQQLHQLPRGRLDLATQSLTVETCRALGKLLPRETLCTELVLSDCMLSEEGATLLLRGLCANTVLRFLDLKGNNLRAAGAEALGKLLQQNKSIQSLTLEWNSLGTWDDAFATFCGGLAANGALQRLDLRNNQISHKGAEELALALKGNTTLQQLDLRWNNVGLLGGRALMNCLPSNRTLWRLDLAGNNIPGDVLRAVEQAMGHSQDRLTTFQENQARTHVLSKEVQHLREEKSKQFLDLMETIDKQREEMAKSSRASAARVGQLQEALNERHSIINALKAKLQMTEAALALSEQKAQDLGELLATAEQEQLSLSQRQAKELKLEQQEAAERESKLLRDLSAANEKNLLLQNQVDELERKFRCQQEQLFQTRQEMTSMSAELKMRAIQAEERLDMEKRRCRQSLEDSESLRIKEVEHMTRHLEESEKAMQERVQRLEAARLSLEEELSRVKAAALSERGQAEEELIKAKSQARLEEQQRLAHLEDKLRLLAQARDEAQGACLQQKQVVAEAQTRVSQLGLQVEGLRRRLEELQQELSLKDQERVAEVSRVRVELQEQNGRLQAELAAQEALREKAAALERQLKVMASDHREALLDRESENASLREKLRLREAEIARIRDEEAQRASFLQNAVLAYVQASPVRTLSPPK

SEQ ID NO: 1027590 - protein, 695 aa, Homo sapiens
MEEFRRSYSRLCRESGAEPQEAVLQQLHQLPRGRLDLATQSLTVETCRALGKLLPRETLCTELVLSDCMLSEEGATLLLRGLCANTVLRFLDLKGNNLRAAGAEALGKLLQQNKSIQSLTLEWNSLGTWDDAFATFCGGLAANGALQRLDLRNNQISHKGAEELALALKGNTTLQQLDLRWNNVGLLGGRALMNCLPSNRTLWRLDLAGNNIPGDVLRAVEQAMGHSQDRLTTFQENQARTHVLSKEVQHLREEKSKQFLDLMETIDKQREEMAKSSRASAARVGQLQEALNERHSIINALKAKLQMTEAALALSEQKAQDLGELLATAEQEQLSLSQRQAKELKLEQQEAAERESKLLRDLSAANEKNLLLQNQVDELERKFRCQQEQLFQTRQEMTSMSAELKMRAIQAEERLDMEKRRCRQSLEDSESLRIKEGGEIREEKVGRPALHSGPTIPAPEQVEHMTRHLEESEKAMQERVQRLEAARLSLEEELSRVKAAALSERGQAEEELIKAKSQARLEEQQRLAHLEDKLRLLAQARDEAQGACLQQKQVVAEAQTRVSQLGLQVEGLRRRLEELQQELSLKDQERVAEVSRVRVELQEQNGRLQAELAAQEALREKAAALERQLKVMASDHREALLDRESENASLREKLRLREAEIARIRDEEAQRASFLQNAVLAYVQASPVRTLSPPK

SEQ ID NO: 1027591 - protein, 478 aa, Homo sapiens [sequence omitted]

SEQ ID NO: 1027592 - protein, 649 aa, Homo sapiens
MTSQRDLLASANPDHRDSCPFLGLGSCPEKGPTGQGLAGQQGQRVTAGPPYTGATLLLRGLCANTVLRFLDLKGNNLRAAGAEALGKLLQQNKSIQSLTLEWNSLGTWDDAFATFCGGLAANGALQRLDLRNNQISHKGAEELALALKGNTTLQQLDLRWNNVGLLGGRALMNCLPSNRTLWRLDLAGNNIPGDVLRAVEQAMGHSQDRLTTFQENQARTHVLSKEVQHLREEKSKQFLDLMETIDKQREEMAKSSRASAARVGQLQEALNERHSIINALKAKLQMTEAALALSEQKAQDLGELLATAEQEQLSLSQRQAKELKLEQQEAAERESKLLRDLSAANEKNLLLQNQVDELERKFRCQQEQLFQTRQEMTSMSAELKMRAIQAEERLDMEKRRCRQSLEDSESLRIKEVEHMTRHLEESEKAMQERVQRLEAARLSLEEELSRVKAAALSERGQAEEELIKAKSQARLEEQQRLAHLEDKLRLLAQARDEAQGACLQQKQVVAEAQTRVSQLGLQVEGLRRRLEELQQELSLKDQERVAEVSRVRVELQEQNGRLQAELAAQEALREKAAALERQLKVMASDHREALLDRESENASLREKLRLREAEIARIRDEEAQRASFLQNAVLAYVQASPVRTLSPPK

SEQ ID NO: 1027593 - protein, 373 aa, Homo sapiens
EEMAKSSRASAARVGQLQEALNERPPSPVPGAGTAPHRAAPFQQLREHAEEALPAPRVMEEFRRSYSRLCRESGAEPQEAVLQQLHQLPRGRLFQTRQEMTSMSAELKMRAIQAEERLDMEKRRCRQSLEDSESLRIKEVEHMTRHLEESEKAMQERVQRLEAARLSLEEELSRVKAAALSERGQAEEELIKAKSQARLEEQQRLAHLEDKLRLLAQARDEAQGACLQQKQVVAEAQTRVSQLGLQVEGLRRRLEELQQELSLKDQERVAEVSRVRVELQEQNGRLQAELAAQEALREKAAALERQLKVMASDHREALLDRESENASLREKLRLREAEIARIRDEEAQRASFLQNAVLAYVQASPVRTLSPPK

SEQ ID NO: 1027594 - protein, 218 aa, Homo sapiens
EACNQDALQEAGTFRHTLWKRVQGAVTPLLASMISFIDRDGNLELLTRPDTPPWARDLWMFIFSDTMLLNIPLVMNNERHKGEMAYIVVQNHMNLSENASNNVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLPTIVGPAR

SEQ ID NO: 1027595 - protein, 205 aa, Homo sapiens
MLRTHLADASHILDNESLGRKPGTQVYMQQQPGPLVGRWEGHRSATPCCPSPQTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPV

SEQ ID NO: 1027596 - protein, 1511 aa, Homo sapiens
DLEDPMRDASINVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027597 - protein, 1601 aa, Homo sapiens
EACNQDALQEAGTFRHTLWKRVQGAVTPLLASMISFIDRDGNLELLTRPDTPPWARDLWMFIFSDTMLLNIPLVMNNERHKGEMAYIVVQNHMNLSENASNNVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027598 - protein, 557 aa, Homo sapiens
MTRKSAPTSGLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027599 - protein, 462 aa, Homo sapiens
SDLRILITCIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027600 - protein, 1229 aa, Homo sapiens
DLEDPMRDASINVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLAPSGLPPYPATHSLGSASGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027601 - protein, 1511 aa, Homo sapiens; identical to SEQ ID NO: 1027596

SEQ ID NO: 1027602 - protein, 224 aa, Homo sapiens [sequence omitted]

SEQ ID NO: 1027603 - protein, 125 aa, Homo sapiens
TSARYPEKMPQTKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027604 - protein, 1511 aa, Homo sapiens; identical to SEQ ID NO: 1027596

SEQ ID NO: 1027605 - protein, 1511 aa, Homo sapiens; identical to SEQ ID NO: 1027596

SEQ ID NO: 1027606 - protein, 1511 aa, Homo sapiens; identical to SEQ ID NO: 1027596

SEQ ID NO: 1027607 - protein, 1511 aa, Homo sapiens; identical to SEQ ID NO: 1027596

SEQ ID NO: 1027608 - protein, 1374 aa, Homo sapiens
DLEDPMRDASINVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGTHREKTVSREGDAWGWKKEALCLPRGWKELLLFPPFTPAWLRPAVFGSVCTQVFSEHIWGVFSSEVSPVGHSPTMLGARVIHTERGQKEGSSRVT

SEQ ID NO: 1027609 - protein, 268 aa, Homo sapiens
DLEDPMRDASINVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKGLPGLVE

SEQ ID NO: 1027610 - protein, 146 aa, Homo sapiens
TLQDPARGVINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGTNEPATSHPT

SEQ ID NO: 1027611 - protein, 1344 aa, Homo sapiens
MACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027612 - protein, 1673 aa, Homo sapiens
DLEDPMRDASINVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQVIPINLILCTGLSAFSVCFPPCLAYSSLAPGVCCEPTVSAASLTESKQDSKSASFLVEEKQIDISVGLILRNDVDAMAMPAEAGSPWNRFVPALRMRVLIGRPVCLHGLQELPAHRAPKCQLLESWPPACGLGSEGARLSYQVVEMPETQPTDIPLLLFISQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027613 - protein, 443 aa, Homo sapiens
MVTGWSSLLQEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027614 - protein, 258 aa, Homo sapiens
MFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 1027615 - protein, 1511 aa, Homo sapiens; identical to SEQ ID NO: 1027596

SEQ ID NO: 1027616 - protein, 1511 aa, Homo sapiens; identical to SEQ ID NO: 1027596

SEQ ID NO: 1027617 - protein, 1511 aa, Homo sapiens; identical to SEQ ID NO: 1027596

SEQ ID NO: 1027618 - protein, 1511 aa, Homo sapiens; identical to SEQ ID NO: 1027596

SEQ ID NO: 1027619 - protein, 1483 aa, Homo sapiens
DLEDPMRDASINVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWRYGFAHLWGGADTMLCCLSCDLL

SEQ ID NO: 1027620 - protein, 312 aa, Homo sapiens
DLEDPMRDASINVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPV

SEQ ID NO: 1027621 - protein, 270 aa, Homo sapiens
IHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDLYKHVFWATRLAKKLLGWLLFKTPDEGAWTSIYAAVTPELEGVGGRYLYNEKETKSLHVTYNQKLQQQLWSKSCEMTGVLDVTL

SEQ ID NO: 1027622 - protein, 270 aa, Homo sapiens; identical to SEQ ID NO: 1027621

SEQ ID NO: 1027623 - protein, 270 aa, Homo sapiens; identical to SEQ ID NO: 1027621

SEQ ID NO: 1027624 - protein, 259 aa, Homo sapiens
DNWALWNHFFVFRRDCQASPTPWNLEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDLYKHVFWATRLAKKLLGWLLFKTPDEGAWTSIYAAVTPELEGVGGRYLYNEKETKSLHVTYNQKLQQQLWSKSCEMTGVLDVTL

SEQ ID NO: 1027625 - protein, 270 aa, Homo sapiens; identical to SEQ ID NO: 1027621

SEQ ID NO: 1027626 - protein, 440 aa, Homo sapiens [sequence omitted]

SEQ ID NO: 1027627 - protein, 240 aa, Homo sapiens
MGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 1027628 - protein, 583 aa, Homo sapiens
ASTNVWVQYVWHTEWGVCLPTVSLWILFVYIEAAIRFKDLKNFHVDLCRPFAAHCIGYPVVTLGFGFKSYVSYKMRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQAESIDIDAKNYLVALAVDDDGEELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 1027629 - protein, 544 aa, Homo sapiens
ASTNVWVQYVWHTEWGVCLPTVSLWILFVYIEAAIRFKDLKNFHVDLCRPFAAHCIGYPVVTLGFGFKSYVSYKMRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVPALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 1027630 - protein, 561 aa, Homo sapiens
ASTNVWVQYVWHTEWGVCLPTVSLWILFVYIEAAIRFKDLKNFHVDLCRPFAAHCIGYPVVTLGFGFKSYVSYKMRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 1027631 - protein, 440 aa, Homo sapiens [sequence omitted]

SEQ ID NO: 1027632 - protein, 561 aa, Homo sapiens; identical to SEQ ID NO: 1027630

SEQ ID NO: 1027633 - protein, 124 aa, Homo sapiens [sequence omitted]

SEQ ID NO: 1027634 - protein, 465 aa, Homo sapiens
TRMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNRLLMSLFLFFFVLFLCLFFYNCYKGYLPRQCLKFRSALLIGKKKPKSDFCDREQSLKETLVEPGSFSQQNGEHPKPALDTGYETEQDTITSKVPTDREDSQRIDDLSARDKPFDVKCELKFADSDADGD

SEQ ID NO: 1027635 - protein, 572 aa, Homo sapiens
MFCITISSSFACRPFGIPVMLGLCWIQTLTRGSPPTGAHILARGTRLGFEVVCFSLWLQPLLTYSEAGKMTGSARLMHPLLQGGDLEVGTEQPPHWLRETRAEKRFAGGQAPVGAQTGERGIWTYGPVSPDIARGFCRKVTDLPCLPLVLSTSPPYCNVPCRYTLAASHTLVQKQRPCSWMPACLMLVLLCQGNRFVYAGSNSGVVQAPLAFCGKHGTCEDCVLARDPYCAWSPPTATCVALHQTESPSRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNRLLMSLFLFFFVLFLCLFFYNCYKGYLPRQCLKFRSALLIGKKKPKSDFCDREQSLKETLVEPGSFSQQNGEHPKPALDTGYETEQDTITSKVPTDREDSQRIDDLSARDKPFDVKCELKFADSDADGD

SEQ ID NO: 1027636 - protein, 572 aa, Homo sapiens; identical to SEQ ID NO: 1027635

SEQ ID NO: 1027637 - protein, 572 aa, Homo sapiens; identical to SEQ ID NO: 1027635

SEQ ID NO: 1027638 - protein, 572 aa, Homo sapiens; identical to SEQ ID NO: 1027635

SEQ ID NO: 1027639 - protein, 352 aa, Homo sapiens
ESPSRYGAGCAAWGCPPCVWVNNTCRLFCRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNRLLMSLFLFFFVLFLCLFFYNCYKGYLPRQCLKFRSALLIGKKKPKSDFCDREQSLKETLVEPGSFSQQNGEHPKPALDTGYETEQDTITSKVPTDREDSQRIDDLSARDKPFDVKCELKFADSDADGD

SEQ ID NO: 1027640 - protein, 572 aa, Homo sapiens; identical to SEQ ID NO: 1027635

SEQ ID NO: 1027641 - protein, 239 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLERPENSVFPWAF

SEQ ID NO: 1027642 - protein, 187 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLHLLLILYLVAIGTRSCNCKYTFNKIRSDQMEE

SEQ ID NO: 1027643 - protein, 300 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRDPFPGFEPSHPGSLTNRPLCCDEQPHRSLWPLERCIKALHCMIRGMQDWYPAKVQVAYALTSCDEWELYEYTQVIDPRTAAMDSAVR

SEQ ID NO: 1027644 - protein, 274 aa, Homo sapiens
MDDNLLLSDEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVFTMLTQGNGFEISSSDATVKILITTVPPNLRKLDPELHLDIKVLQSALAAIRHARWFEENASQSTVKVLIRLLKDLRDPFPGFEPSHPGSLTNRPLCCDEQPHRSLWPLERCDTVRMHCMIRGMQDWYPAKVQVAYALTSCDEWELYEYTQVIDPRTAAMDSAVR

SEQ ID NO: 1027645 - protein, 318 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRDPFPGFEPSHPGSLTNRPLCCDEQPHRSLWPLERCIKALHCMIRGMQDWYPAKVQVAYALTSCDEWELYEYTQVIDPRTAAMDSAVR

SEQ ID NO: 1027646 - protein, 160 aa, Homo sapiens
TGSESSSVPGLLGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTKQPWY

SEQ ID NO: 1027647 - protein, 153 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVKQASGNSYHYY

SEQ ID NO: 1027648 - protein, 1798 aa, Homo sapiens
MELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARAFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 1027649 - protein, 1798 aa, Homo sapiens
MELTSTERGRGQPLPWELRLPLLLSVLAATLAQAPAPDVPGCSRGSCYPATADLLVGRADRLTASSTCGLNGRQPYCIVSHLQDEKKCFLCDSRRPFSARDNPHTHRIQNVVTSFAPQRRAAWWQSQNGIPAVTIQLDLEAEFHFTHLIMTFKTFRPAAMLVERSADFGRTWHVYRYFSYHCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCDRHGHTHSCHFDMAVYLGSGNVSGGVCDGCQHNTAWRHCELCRPFFYRDPTKDLRDPAVCRSCDCDPMGSQDGGRCDSHDDPALGLVSGQCRCKEHVVGTRCQQCRDGFFGLSISDPSGCRRCQCNARGTVPGSTPCDPNSGSCYCKRLVTGRGCDRCLPGHWGLSLDLLGCRPCDCDVGGALDPQCDEGTGQCHCRQHMVGRRCEQVQPGYFRPFLDHLIWEAENTRGQVLDVVERLVTPGETPSWTGSGFVRLQEGQTLEFLVASVPNAMDYDLLLRLEPQVPEQWAELELIVQRPGPVPAHSLCGHLVPRDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDTCAPGYYGFGPTGCQACQCSPRGALSSLCERTSGQCLCRTGAFGLRCDACQRGQWGFPSCRPCVCNGHADECNTHTGACLGCRDLTGGEHCERCIAGFHGDPRLPYGAQCRPCPCPEGPGSQRHFATSCHQDEYSQQIVCHCRAGYTGLRCEACAPGQFGDPSRPGGRCQLCECSGNIDPMDPDACDPHPGQCLRCLHHTEGPHCAHSKPGFHGQAARQSCHRCTCNLLGTNPQQCPSPDQCHCDPSSGQCPCLPNVQALAVDRCAPNFWNLTSGHGCQPCACLPSPEEGPTCNEFTGQCHCLCGFGGRTCSECQELHWGDPGLQCHACDCDSRGIDTPQCHRFTGHCTCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAQGLHHDRTSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLPDEARDLLQAAQDKLQRLQELEGTYEENERALESKAAQLDGLEARMRSVLQAINLQVQIYNTCQ

SEQ ID NO: 1027650 - protein, 170 aa, Homo sapiens
CAACFKPSTCRCRSTTPASDPCPRAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEATAQQASALPGHR

SEQ ID NO: 1027651 - protein, 1267 aa, Homo sapiens
MRSSLGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 1027652 - protein, 1001 aa, Homo sapiens
MVVSACASLEWLGAAVTSVPLATMALAPQAVKPASAATRGHSAVSVKRPVGNVSVELVPLGFAVTAASVASGDSLAAGHVSAMGMQMSATPTQALAWAAVITQGVSTVKGALLVSTGTHGCHMGASAGPVPVLKALGANGTLLLLATRMNIPSRLCATAGQAIRGCDVKLVPLGTLGTHQGQVAGANCVSAVGTLTQWILMPVTPTRGNACAVYTTQRVHTVPTASLASMGRLPDRAVTAAHATCWAQIRSSAHLLTSATVIQAVGSAHASPMSRALAVTAVPPTSGTSPVAMVASLVPATQAGPEATTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 1027653 - protein, 616 aa, Homo sapiens
SDTPKQWLKTLADTPHTLVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 1027654 - protein, 509 aa, Homo sapiens
GVDSIRLLKHSTLGELLATLVQVDQDQSSADCLPLPNLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 1027655 - protein, 1881 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQGKKWGTRDTRLRETPPKLTPALPRIGRHL

SEQ ID NO: 1027656 - protein, 1881 aa, Homo sapiens; identical to SEQ ID NO: 1027655

SEQ ID NO: 1027657 - protein, 1650 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNREPPTCPRPCGCPLWQLPVSVSPLVHT

SEQ ID NO: 1027658 - protein, 1284 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGNWKAPMRKMSGHWRVRQPSWTGWRPGCAACFKPSTCRCRSTTPASDPCPRPTPVPSTAPHACLPMH

SEQ ID NO: 1027659 - protein, 969 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPVSVCDVGDGAEVGTQPDLAQPSSPHACQCNPQGSLSSECNPHGGQCLCKPGVVGRRCDLCAPGYYGFGPTGCQALHLPRDGLR

SEQ ID NO: 1027660 - protein, 1650 aa, Homo sapiens; identical to SEQ ID NO: 1027657

SEQ ID NO: 1027661 - protein, 1676 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVRLKCWVGQVGVMFLSQGPDLFCAWQVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNREPPTCPRPCGCPLWQLPVSVSPLVHT

SEQ ID NO: 1027662 - protein, 700 aa, Homo sapiens
FRGSSPRTPNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 1027663 - protein, 284 aa, Homo sapiens [sequence omitted]

SEQ ID NO: 1027664 - protein, 1897 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 1027665 - protein, 1872 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEATAQQASALPGHR

SEQ ID NO: 1027666 - protein, 1700 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLEEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 1027667 - protein, 973 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQGYSSAPCSLLCFSLLPITVLSPPSGPAAGFLKLSLGPSTLTLGQL

SEQ ID NO: 1027668 - protein, 738 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVRPCYLIWS

SEQ ID NO: 1027669 - protein, 1798 aa, Homo sapiens; identical to SEQ ID NO: 1027648

SEQ ID NO: 1027670 - protein, 1650 aa, Homo sapiens; identical to SEQ ID NO: 1027657

SEQ ID NO: 1027671 - protein, 1005 aa, Homo sapiens
RQFPEGRGRVGVGALSARCCAPSQNPLRPFLPAAIPNFAQSRWTLSCRRDRWTDLGTDRGPGGKQAKDPQAELTRNPKARRRARARDRSPPLIPVPLFRMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPVSVCDVGVMGQRWGPSPDLAQPSSPHACQCNPQGSLSSECNPHGGQCLCKPGVVGRRCDLCAPGYYGFGPTGCQGYSSAPCSLLCFSLLPITVLSPPSGPAAGFLKLSLGPSTLTLGQL

SEQ ID NO: 1027672 - protein, 185 aa, Homo sapiens
MEGYSKVGCKSEKPEEGFWVMLPGWWAPMGSLEGVCLGRLVSGGSFVCQAENCPEELRVEGPGASGLRPDCGPELRSQRTHRRGRGHSFTLQETSRILREMLTNHKKTKNSREWRLKPVIPVLFERWRQEDHVSPTVREQPGQHSETLFLQTFQKLVEHGGMCLVPAPREAEERRLLEPRNWRLQ

SEQ ID NO: 1027673 - protein, 258 aa, Homo sapiens
MNALVLPGGEAGPAEIRYDHSQEILMERKEHREGEVTSWKRKIVERGNEGLGRGCPSEKGPQCWGDYSFGNCGMEGYSKVGCKSEKPEEGFWVMLPGWWAPMGSLEGVCLGRLVSGGSFVCQAENCPEELRVEGPGASGLRPDCGPELRSQRTHRRGRGHSFTLQETSRILREMLTNHKKTKNSREWRLKPVIPVLFERWRQEDHVSPTVREQPGQHSETLFLQTFQKLVEHGGMCLVPAPREAEERRLLEPRNWRLQ

SEQ ID NO: 1027674 - protein, 174 aa, Homo sapiens
EAQEPCSLLYAPETFVQLDQSLSRLEEQCVDALQAQGFSQVGFQGAPGQRAYVVLTTPLVGVPPDDFPGGPGLCEKQNRCPCRALGGVGSGQGVWFELPPTNLLPRSQISTESFLHLRYQGTDCALMVSAHQHPATARSPRAGGFGEPSWTGTCFLTPSPGKGPPLCLWGSSKY

SEQ ID NO: 1027675 - protein, 759 aa, Homo sapiens
EAQEPCSLLYAPETFVQLDQSLSRLEEQCVDALQAQGFPRSQISTESFLHLRYQGTDCALMVSAHQHPATARSPRAGGFGAAFVERYMREFGFVIPERPVVVDDVRVRGTGRSGLRLEDAPKAQTGPPRVDKMTQCYFEGGYQETPVYLLAELGYGHKLHGPCLIIDSNSTILVEPGCQAEVTKTGDICISVGAEVPGTVGPQLDPIQLSIFSHRFMSIAEQMGRILQRTAISTNIKERLDFSCALFGPDGGLVSNAPHIPVHLGAMQETVQFQIQHLGADLHPGDVLLSNHPSAGGSHLPDLTVITPVFWPGQTRPVFYVASRGHHADIGGITPGSMPPHSTMLQQEGAVFLSFKLVQGGVFQEEAVTEALRAPGKVPNCSGTRNLHDNLSDLRAQVAANQKGIQLVGELIGQYGLDVVQAYMGHIQANAELAVRDMLRAFGTSRQARGLPLEVSSEDHMDDGSPIRLRVQISLSQGSAVFDFSGTGPEVFGNLNAPRAVTLSALIYCLRCLVGRDIPLNQGCLAPVRVVIPRGSILDPSPEAAVVGGNVLTSQRVVDVILGAFGACAASQGCMNNVTLGNAHMGYYETVAGGAGAGPSWHGRSGVHSHMTNTRITDPEILESRYPVILRRFELRRGSGGRGRFRGGDGVTRELLFREEALLSVLTERRAFRPYGLHGGEPGARGLNLLIRKNGRTVNLGGKTSVTVYPGDVFCLHTPGGGGYGDPEDPAPPPGSPPQALAFPEHGSVYEYRRAQEAV

SEQ ID NO: 1027676 - protein, 835 aa, Homo sapiens
GQPLDSSHIASIRMGTTVATNALLERKGERVALLVTRGFRDLLHIGTQARGDLFDLAVPMPEVLYEEVLEVDERVVLHRGEAGTGTPVKGRTGDLLEVQQPVDLGALRGKLEGLLSRGIRSLAVVLMHSYTWAQHEQQVGVLARELGFTHVSLSSEAMPMVRIVPRGHTACADAYLTPAIQRYVQGFCRGFQGQLKDVQVLFMRSDGGLAPMDTFSGSSAVLSGPAGGVVGYSATTYQQEGGQPVIGFDMGGTSTDVSRYAGEFEHVFEASTAGVTLQAPQLDINTVAAGGGSRLFFRSGLFVVGPESAGAHPGPACYRKGGPVTVTDANLVLGRLLPASFPCIFGPGENQPLSPEASRKALEAVATEVNSFLTNGPCPASPLSLEEVAMGFVRVANEAMCRPIRALTQVRPPLLSRLLLPPAFVERYMREFGFVIPERPVVVDDVRVRGTGRSGLRLEDAPKAQTGPPRVDKMTQCYFEGGYQETPVYLLAELGYGHKLHGPCLIIDSNSTILVEPGCQAEVTKTGDICISVGAEVPGTVGPQLDPIQLSIFSHRFMSIAEQMGRILQRTAISTNIKERLDFSCALFGPDGGLVSNAPHIPVHLGAMQETVQFQIQHLGADLHPGDVLLSNHPSAGGSHLPDLTVITPVFWPGQTRPVFYVASRGHHADIGGITPGSMPPHSTMLQQEGAVFLSFKLVQGGVFQEEAVTEALRAPGKVPNCSGTRNLHDNLSDLRAQVAANQKGIQLVGELIGQYGLDVVQAYMGHIQANAELAVRDMLRAFGTSRQARGLPLEVSSEDHMDDGSPIRLRVQISLSQVGRGESASRRQGHGAAA

SEQ ID NO: 1027677 - protein, 1177 aa, Homo sapiens
GQPLDSSHIASIRMGTTVATNALLERKGERVALLVTRGFRDLLHIGTQARGDLFDLAVPMPEVLYEEVLEVDERVVLHRGEAGTGTPVKGRTGDLLEVQQPVDLGALRGKLEGLLSRGIRSLAVVLMHSYTWAQHEQQVGVLARELGFTHVSLSSEAMPMVRIVPRGHTACADAYLTPAIQRYVQGFCRGFQGQLKDVQVLFMRSDGGLAPMDTFSGSSAVLSGPAGGVVGYSATTYQQEGGQPVIGFDMGGTSTDVSRYAGEFEHVFEASTAGVTLQAPQLDINTVAAGGGSRLFFRSGLFVVGPESAGAHPGPACYRKGKSQDLAGLALPSAAAAGPAPPVSPIPAAYSCSPASSPQAPHPVHLPGGPVTVTDANLVLGRLLPASFPCIFGPGENQPLSPEASRKALEAVATEVNSFLTNGPCPASPLSLEEVAMGFVRVANEAMCRPIRALTQVRPPLLSRLLLPPAFVERYMREFGFVIPERPVVVDDVRVRGTGRSGLRLEDAPKAQTGPPRVDKMTQCYFEGGYQETPVYLLAELGYGHKLHGPCLIIDSNSTILVEPGCQAEVTKTGDICISVGAEVPGTVGPQLDPIQLSIFSHRFMSIAEQMGRILQRTAISTNIKERLDFSCALFGPDGGLVSNAPHIPVHLGAMQETVQFQIQHLGADLHPGDVLLSNHPSAGGSHLPDLTVITPVFWPGQTRPVFYVASRGHHADIGGITPGSMPPHSTMLQQEGAVFLSFKLVQGGVFQEEAVTEALRAPGKVPNCSGTRNLHDNLSDLRAQVAANQKGIQLVGELIGQYGLDVVQAYMGHIQANAELAVRDMLRAFGTSRQARGLPLEVSSEDHMDDGSPIRLRVQISLSQGSAVFDFSGTGPEVFGNLNAPRAVTLSALIYCLRCLVGRDIPLNQGCLAPVRVVIPRGSILDPSPEAAVVGGNVLTSQRVVDVILGAFGACAASQGCMNNVTLGNAHMGYYETVAGGAGAGPSWHGRSGVHSHMTNTRITDPEILESRYPVILRRFELRRGSGGRGRFRGGDGVTRELLFREEALLSVLTERRAFRPYGLHGARFPSPRGPPQPPPPPPPLVSLDSSPPSAGGEPGARGLNLLIRKNGRTVNLGGKTSVTVYPGDVFCLHTPGGGGYGDPEDPAPPPGSPPQALAFPEHGSVYEYRRAQEAV

SEQ ID NO: 1027678 - protein, 1100 aa, Homo sapiens
GQPLDSSHIASIRMGTTVATNALLERKGERVALLVTRGFRDLLHIGTQARGDLFDLAVPMPEVLYEEVLEVDERVVLHRGEAGTGTPVKGRTGDLLEVQQPVDLGALRGKLEGLLSRGIRSLAVVLMHSYTWAQHEQQVGVLARELGFTHVSLSSEAMPMVRIVPRGHTACADAYLTPAIQRYVQGFCRGFQGQLKDVQVLFMRSDGGLAPMDTFSGSSAVLSGPAGGVVGYSATTYQQEGGQPVIGFDMGGTSTDVSRYAGEFEHVFEASTAGVTLQAPQLDINTVAAGGGSRLFFRSGLFVVGPESAGAHPGPACYRKGGPVTVTDANLVLGRLLPASFPCIFGPGENQPLSPEASRKALEAVATEVNSFLTNGPCPASPLSLEEVAMGFVRVANEAMCRPIRALTQVRPPLLSRLLLPPAFVERYMREFGFVIPERPVVVDDVRVRGTGRSGLRLEDAPKAQTGPPRVDKMTQCYFEGGYQETPVYLLAELGYGHKLHGPCLIIDSNSTILVEPGCQAEVTKTGDICISVGAEVPGTVGPQLDPIQLSIFSHRFMSIAEQMGRILQRTAISTNIKERLDFSCALFGPDGGLVSNAPHIPVHLGAMQETVQFQIQHLGADLHPGDVLLSNHPSAGGSHLPDLTVITPVFWPGQTRPVFYVASRGHHADIGGITPGSMPPHSTMLQQEGAVFLSFKLVQGGVFQEEAVTEALRAPGKVPNCSGTRNLHDNLSDLRAQVAANQKGIQLVGELIGQYGLDVVQAYMGHIQANAELAVRDMLRAFGTSRQARGLPLEVSSEDHMDDGSPIRLRVQISLSQGSAVFDFSGTGPEVFGNLNAPRAVTLSALIYCLRCLVGRDIPLNQGCLAPVRVVIPRGSILDPSPEAAVVGGNVLTSQRVVDVILGAFGACAASQGCMNNVTLGNAHMGYYETVAGGAGAGPSWHGRSGVHSHMTNTRITDPEILESRYPVILRRFELRRGSGGRGRFRGGDGVTRELLFREEALLSVLTERRAFRPYGLHGGEPGARGLNLLIRKNGRTVNLGGKTSVTVYPGDVFCLHTPGGGGYGDPEDPAPPPGSPPQALAFPEHGSVYEYRRAQEAV

SEQ ID NO: 1027679 - protein, 986 aa, Homo sapiens
GQPLDSSHIASIRMGTTVATNALLERKGERVALLVTRGFRDLLHIGTQARGDLFDLAVPMPEVLYEEVLEVDERVVLHRGEAGTGTPVKGRTGDLLEVQQPVDLGALRGKLEGLLSRGIRSLAVVLMHSYTWAQHEQQVGVLARELGFTHVSLSSEAMPMVRIVPRGHTACADAYLTPAIQRYVQGFCRGFQGQLKDVQVLFMRSDGGLAPMDTFSGSSAVLSGPAGGVVGYSATTYQQEGGQPVIGFDMGGTSTDVSRYAGEFEHVFEASTAGVTLQAPQLDINTVAAGGGSRLFFRSGLFVVGPESAGAHPGPACYRKGGPVTVTDANLVLGRLLPASFPCIFGPGENQPLSPEASRKALEAVATEVNSFLTNGPCPASPLSLEEVAMGFVRVANEAMCRPIRALTQVRPPLLSRLLLPPAFVERYMREFGFVIPERPVVVDDVRVRGTGRSGLRLEDAPKAQTGPPRVDKMTQCYFEGGYQETPVYLLAELGYGHKLHGPCLIIDSNSTILVEPGCQAEVTKTGDICISVGAEVPGTVGPQLDPIQLSIFSHRFMSIAEQMGRILQRTAISTNIKERLDFSCALFGPDGGLVSNAPHIPVHLGAMQETVQFQIQHLGADLHPGDVLLSNHPSAGGSHLPDLTVITPVFWPGQTRPVFYVASRGHHADIGGITPGSMPPHSTMLQQEGAVFLSFKLVQGGVFQEEAVTEALRAPGKVPNCSGTRNLHDNLSDLRAQVAANQKGIQLVGELIGQYGLDVVQAYMGHIQANAELAVRDMLRAFGTSRQARGLPLEVSSEDHMDDGSPIRLRVQISLSQGSAVFDFSGTGPEVFGNLNAPRAVTLSALIYCLRCLVGRDIPLNQGCLAPVRVVIPRGSILDPSPEAAVVGGNVLTSQRVVDVILGAFGACAASQGCMNNVTLGNAHMGYYETVAGGAGAGPSWHGRSGVHSHMTNTRITDPEILESRYPATASPASCSFVRRRCCQC

SEQ ID NO: 1027680 - protein, 131 aa, Homo sapiens [sequence omitted]

SEQ ID NO: 1027681 - protein, 72 aa, Homo sapiens
ELHSVASCTPQPVPTFQLTLRRLLTTLQDPGLCNSANSPFLPGFSQSLTLSTGFRVIKKKLYSSEQLLIEEC

SEQ ID NO: 1027682 - protein, 388 aa, Homo sapiens
RRHTYWPPRRPVAASRCWPVGATPLGSVGGRTGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVVRGGHLSTQAFGAECCLGMTRKTFGFLRFFFSMLG

SEQ ID NO: 1027683 - protein, 95 aa, Homo sapiens
GVGACGVGLTGCLLPVGLWPVGPSGHEHFSLLSATTGGTGPTSDTGWGCMLRCGQMIFAQALVCRHLGRGESQPWGGRMATVFSGSKGDCGVRAL

SEQ ID NO: 1027684 - protein, 393 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVEQQPSHLACPDVLNLSLDSSDVERLERFFDSEDEDFEILSL

SEQ ID NO: 1027685 - protein, 141 aa, Homo sapiens
MKTLKSCPFENPGVGGGTCESLGLLVPLRFIHPARSPAEGCAPCCLPPEGHPLCSWTEAALPGRPYCLVSDCPAQSARQGLCIRTRSRLLGASRVFSRHCQPRVSTWASVPLAPRRRFCGWFGIKVLFEVVRHRHEFLGAP

SEQ ID NO: 1027686 - protein, 141 aa, Homo sapiens; identical to SEQ ID NO: 1027685

SEQ ID NO: 1027687 - protein, 538 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVEQQPSHLACPDVLNLSLGESCQVQVGSLGGTICALASPVLAPLVLTIKVCVSLSREHLAVVLPVRPGMEWSVPSSKLAPSSPGPTSSSPPALPAGALWSWACYHGVLRGLEQTEHAGSVVTQSWVGDWFTWAPLAMGGVDPSDHGQRAAGAGLGSCSEVSGRERVLLISVSLWKTLQTRQWQWNHS

SEQ ID NO: 1027688 - protein, 393 aa, Homo sapiens; identical to SEQ ID NO: 1027684

SEQ ID NO: 1027689 - protein, 141 aa, Homo sapiens; identical to SEQ ID NO: 1027685

SEQ ID NO: 1027690 - protein, 141 aa, Homo sapiens; identical to SEQ ID NO: 1027685

SEQ ID NO: 1027691 - protein, 141 aa, Homo sapiens; identical to SEQ ID NO: 1027685

SEQ ID NO: 1027692 - protein, 141 aa, Homo sapiens; identical to SEQ ID NO: 1027685

SEQ ID NO: 1027693 - protein, 238 aa, Homo sapiens
ARYEAEYEAGRGGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIGRLCRTSVPCAGATAFPADSDRHCNGFPAGAEVTNRPSPWRPLVLLIPLRLGLTDINEAYVETLKHCFMMPQSLGVIGGKPNSAHYFIGYVGEELI

SEQ ID NO: 1027694 - protein, 182 aa, Homo sapiens
ARYEAEYEAGRGGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIGGRLQNVPGPTRAVWRGWSGRFPLRAFLVSWDVEQEAVNL

SEQ ID NO: 1027695 - protein, 380 aa, Homo sapiens [sequence omitted]

SEQ ID NO: 1027696 - protein, 538 aa, Homo sapiens; identical to SEQ ID NO: 1027687

SEQ ID NO: 1027697 - protein, 380 aa, Homo sapiens [sequence omitted]

SEQ ID NO: 1027698 - protein, 457 aa, Homo sapiens
RRHTYWPPRRPVAASRCWPVGATPLGSVGGRTGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVEQQPSHLACPDVLNLSLVENPGVGGGTVRAWALVRGFIIRRGAARWAERPPGAGAVEGGPGEWCESPREGS

SEQ ID NO: 1027699 - protein, 405 aa, Homo sapiens
RLLPCQVKALSRATSRTPAHISCQAPSLPASPKPTSDMKLPWAEPADWVSCACGMSCGLSWTVSSLVPCPLLSPLVSPSWASAGPWAPYGSGWGDRLLPPGTCAQSPAPPQHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVEQQPSHLACPDVLNLSLGESCQVQVGSLGGTICALASPVLAPLVLTIKVCVSLSREHLAVVLPVRPGMEWSVPSSKLAPSSPGPTSSSPPALPAGALWSWACYHGVLRGLEQTEHAGSVVTQSWVGDWFTWAPLAMGGVDPSDHGQRAAGAGLGSCSEVSGRERVLLISVSLWKTLQTRQWQWNHS

SEQ ID NO: 1027700 - protein, 376 aa, Homo sapiens
GRWTQVLLNVMQDFSQPLWQPETSGWRGPCPGLAWVQARRRRYPIYLVHRCGTWFALWHGYHGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEISKWLRVSMDKKVEITGQHTTLPRLSPTGASASVVSRPMPCRCSVGPVRQARCTVASLSYPGGHTKRGEPRLSGGRDLVSHVVFVSWLQIVYEGPAVLRRPRVGILVKLFACLDVRQRDVATISSCTISSKGTS

SEQ ID NO: 1027701 - protein, 393 aa, Homo sapiens; identical to SEQ ID NO: 1027684

SEQ ID NO: 1027702 - protein, 393 aa, Homo sapiens; identical to SEQ ID NO: 1027684

SEQ ID NO: 1027703 - protein, 393 aa, Homo sapiens; identical to SEQ ID NO: 1027684

SEQ ID NO: 1027704 - protein, 141 aa, Homo sapiens; identical to SEQ ID NO: 1027685

SEQ ID NO: 1027705 - protein, 141 aa, Homo sapiens; identical to SEQ ID NO: 1027685

SEQ ID NO: 1027706 - protein, 141 aa, Homo sapiens; identical to SEQ ID NO: 1027685

SEQ ID NO: 1027707 - protein, 141 aa, Homo sapiens; identical to SEQ ID NO: 1027685

SEQ ID NO: 1027708 - protein, 419 aa, Homo sapiens
RRHTYWPPRRPVAASRCWPVGATPLGSVGGRTGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVEQQPSHLACPDVLNLSLGESCQVQVGSLGILLM

SEQ ID NO: 1027709 - protein, 141 aa, Homo sapiens; identical to SEQ ID NO: 1027685

SEQ ID NO: 1027710 - protein, 428 aa, Homo sapiens
RRHTYWPPRRPVAASRCWPVGATPLGSVGGRTGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVEQQPSHLACPDVLNLSLDSSDVERLERFFDSEDEDFEILSLC

SEQ ID NO: 1027711 - protein, 382 aa, Homo sapiens
RRHTYWPPRRPVAASRCWPVGATPLGSVGGRTGKMDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGKQGRLVRSPFLGLHVRVHGAPLCWELQW

SEQ ID NO: 1027712 - protein, 281 aa, Homo sapiens [sequence omitted]

SEQ ID NO: 1027713 - protein, 1116 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 1027714 - protein, 1149 aa, Homo sapiens [sequence omitted]

SEQ ID NO: 1027715 - protein, 1151 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 1027716 - protein, 112 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTASRTCTGISPSRGFDSSWTSQ

SEQ ID NO: 1027717 - protein, 473 aa, Homo sapiens [sequence omitted]

SEQ ID NO: 1027718 - protein, 1116 aa, Homo sapiens; identical to SEQ ID NO: 1027713

SEQ ID NO: 1027719 - protein, 1169 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPHWKTWTIEWSRNSPLSLTITVAFLWSSSSPRIPKTAAEFIKIKFVNVTT

SEQ ID NO: 1027720 - protein, 1050 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATKKIPMSQLISVLLN

SEQ ID NO: 1027721 - protein, 931 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDSYMSLIFQTR

SEQ ID NO: 1027722 - protein, 1059 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTGKCQKPGLSLESLAARGLGSDVCCACRIRYQLDSY

SEQ ID NO: 1027723 - protein, 257 aa, Homo sapiens [sequence omitted]

SEQ ID NO: 1027724 - protein, 1116 aa, Homo sapiens; identical to SEQ ID NO: 1027713

SEQ ID NO: 1027725 - protein, 1156 aa, Homo sapiens
MVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGLWVLGGSIAQGFRSVAAVEAQTFYFDKQLKKSKNVIGSLDAYNGQE

SEQ ID NO: 1027726 - protein, 1151 aa, Homo sapiens; identical to SEQ ID NO: 1027715

SEQ ID NO: 1027727 - protein, 314 aa, Homo sapiens
MALAARLWRLLPFRRGAAPGSRLPAGPSGSRGIAAPARFRGFEVMGNPGTFNRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 1027728 - protein, 396 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQEPDSPRVTLVRDVSPLRVRPITENKPQESLTFSFPCSPHLIVLVWIPELTAGLRCLFPHVHVYQSLKITRVFIIRIWKRSLFNQADLCLSFVFTMNSE

SEQ ID NO: 1027729 - protein, 360 aa, Homo sapiens
MALAARLWRLLPFRRGAAPGSRLPAGTSGSRGHCGPCRFRGFEVMGNPGTFKRGLLLSALSYLGFETYQVISQAAVVHATAKESRCVTEGECGGAISAHCNHCLLGSSDPPTSASQVAGITGMCHDATVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 1027730 - protein, 314 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 1027731 - protein, 69 aa, Homo sapiens
FSSSEHVGCAVQEAEVVQGQPASCRSWRWLLDCGAFCLSDVEPPRGLVSLRGLRAAAGIAAPVDSAASR

SEQ ID NO: 1027732 - protein, 314 aa, Homo sapiens; identical to SEQ ID NO: 1027730

SEQ ID NO: 1027733 - protein, 299 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQA

SEQ ID NO: 1027734 - protein, 372 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQEPDSPRVTLVRDVSPLRVRPITENKPQESLTFSFPCSPHLIVLVWIPELTAGLRCLFPHVHVYQRFCVASPSAS

SEQ ID NO: 1027735 - protein, 234 aa, Homo sapiens
MEVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 1027736 - protein, 167 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKSN

SEQ ID NO: 1027737 - protein, 301 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQGKTYLKLHNKKLAAFWLMKAKDYPAHTEEDKQIQTEAAQLLTSFSEKN

SEQ ID NO: 1027738 - protein, 314 aa, Homo sapiens; identical to SEQ ID NO: 1027727

SEQ ID NO: 1027739 - protein, 242 aa, Homo sapiens
MGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQGKTYLKLHNKKLAAFWLMKAKDYPAHTEEDKQR

SEQ ID NO: 1027740 - protein, 372 aa, Homo sapiens; identical to SEQ ID NO: 1027734

SEQ ID NO: 1027741 - protein, 301 aa, Homo sapiens
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQEII

SEQ ID NO: 1027742 - protein, 66 aa, Homo sapiens
ISIIGYEKWKTLMNSPKPKLVLASCRVLCSLTYVHRNFLLEEDQHPENELESCLLQSNLLNHTYNE

SEQ ID NO: 1027743 - protein, 1189 aa, Homo sapiens
MESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGGLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVCPAGAGALEPGAPGSCYLDAGLRRRLREEWGVSCWTLLQAPGEAVLVPAGAPHQVQGLVSTVSVTQHFLSPETSALSAQLCHQGPSLPPDCHLLYAQMDWAVFQAVKVAVGTLQEAK

SEQ ID NO: 1027744 - protein, 1189 aa, Homo sapiens; identical to SEQ ID NO: 1027743

SEQ ID NO: 1027745 - protein, 1257 aa, Homo sapiens
MAQPTASAQKLVRPIRAVCRILQIPESDPSNLRPYSAPAAPGEGERERAEQTERENASSPAGREAPELAHGEQAPGAGHDDRHRPRRDRPVKPRDPPLGEPHEGRRVMESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGDLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQEGITQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVCPAGAGALEPGAPGSCYLDAGLRRRLREEWGVSCWTLLQAPGEAVLVPAGAPHQVQGLVSTVSVTQHFLSPETSALSAQLCHQGPSLPPDCHLLYAQMDWAVFQAVKVAVGTLQEAK

SEQ ID NO: 1027746 - protein, 1101 aa, Homo sapiens
MAQPTASAQKLVRPIRAVCRILQIPESDPSNLRPYSAPAAPGEGERERAEQTERENASSPAGREAPELAHGEQAPGAGHDDRHRPRRDRPVKPRDPPLGEPHEGRRVMESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGDLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGAGPGEHSQRHSALPLP

SEQ ID NO: 1027747 - protein, 1296 aa, Homo sapiens
MAQPTASAQKLVRPIRAVCRILQIPESDPSNLRPYSAPAAPGEGERERAEQTERENASSPAGREAPELAHGEQAPGAGHDDRHRPRRDRPVKPRDPPLGEPHEGRRVMESTPSFLKGTPTWEKTAPENGIVRQEPGSPPRDGLHHGPLCLGEPAPFWRGVLSTPDSWLPPGFPQGPKDMLPLVEGEGPQNGERKVNWLGSKEGLRWKEAMLTHPLAFCGPACPPRCGPLMPEHSGGHLKSDPVAFRPWHCPFLLETKILERAPFWVPTCLPPYLVSGLPPEHPCDWPLTPHPWVYSGGQPKVPSAFSLGSKGFYYKDPSIPRLAKEPLAAAEPGLFGLNSGGHLQRAGEAERPSLHQRDGEMGAGRQQNPCPLFLGQPDTVPWTSWPACPPGLVHTLGNVWAGPGDGNLGYQLGPPATPRCPSPEPPVTQRGCCSSYPPTKGGDLGPCGKCQEGLEGGASGASEPSEEVNKASGPRACPPSHHTKLKKTWLTRHSEQFECPRGCPEVEERPVARLRALKRAGSPEVQGAMGSPAPKRPPDPFPGTAEQGAGGWQEVRDTSIGNKDVDSGQHDEQKGPQDGQASLQDPGLQDIPCLALPAKLAQCQSCAQAAGEGGGHACHSQQVRRSPLGGELQQEEDTATNSSSEEGPGSGPDSRLSTGLAKHLLSGLGDRLCRLLRREREALAWAQREGQGPAVTEDSPGIPRCCSRCHHGLFNTHWRCPRCSHRLCVACGRVAGTGRAREKAGFQEQSAEECTQEAGHAACSLMLTQFVSSQALAELSTAMHQVWVKFDIRGHCPCQADARVWAPGDAGQQKESTQKTPPTPQPSCNGDTHRTKSIKEETPDSAETPAEDRAGRGPLPCPSLCELLASTAVKLCLGHERIHMAFAPVTPALPSDDRITNILDSIIAQVVERKIQEKALGPGLRAGPGLRKGLGLPLSPVRPRLPPPGALLWLQEPQPCPRRGFHLFQEHWRQGQPVLVSGIQRTLQGNLWGTEALGALGGQVQALSPLGPPQPSSLGSTTFWEGFSWPELRPKSDEGSVLLLHRALGDEDTSRVENLAASLPLPEYCALHGKLNLASYLPPGLALRPLEPQLWAAYGVSPHRGHLGTKNLCVEVADLVSILVHADTPLPAWHRAQKDFLSGLDGEGLWSPGSQVSTVWHVFRAQDAQRIRRFLQMVCPAGAGALEPGAPGSCYLDAGLRRRLREEWGVSCWTLLQAPGEAVLVPAGAPHQVQGLVSTVSVTQHFLSPETSALSAQLCHQGPSLPPDCHLLYAQMDWAVFQAVKVAVGTLQEAK

SEQ ID NO: 1027748 - protein, 1189 aa, Homo sapiens; identical to SEQ ID NO: 1027743

SEQ ID NO: 1027749 - protein, 582 aa, Homo sapiens
KILAICPPSPLRPLSLALLPSCASALRCLCPESDIGADSACPGPAEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027750 - protein, 298 aa, Homo sapiens
MHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027751 - protein, 575 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027752 - protein, 483 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027753 - protein, 575 aa, Homo sapiens; identical to SEQ ID NO: 1027751

SEQ ID NO: 1027754 - protein, 575 aa, Homo sapiens; identical to SEQ ID NO: 1027751

SEQ ID NO: 1027755 - protein, 241 aa, Homo sapiens
MHHQKYLQRFLGGKREKKQKQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027756 - protein, 575 aa, Homo sapiens; identical to SEQ ID NO: 1027751

SEQ ID NO: 1027757 - protein, 575 aa, Homo sapiens; identical to SEQ ID NO: 1027751

SEQ ID NO: 1027758 - protein, 575 aa, Homo sapiens; identical to SEQ ID NO: 1027751

SEQ ID NO: 1027759 - protein, 575 aa, Homo sapiens; identical to SEQ ID NO: 1027751

SEQ ID NO: 1027760 - protein, 575 aa, Homo sapiens; identical to SEQ ID NO: 1027751

SEQ ID NO: 1027761 - protein, 601 aa, Homo sapiens
KFWPFALLPPFVRSHWLCWPGSSHTSMDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027762 - protein, 487 aa, Homo sapiens
MDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027763 - protein, 301 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQVPRG

SEQ ID NO: 1027764 - protein, 156 aa, Homo sapiens
DRFDFQFNLPPPRNWGPGVPHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027765 - protein, 549 aa, Homo sapiens
KFWPFALLPPFVRSHWLCCSPDQRSNRPGSSHTSMDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALQGGAWPSAAHSH

SEQ ID NO: 1027766 - protein, 575 aa, Homo sapiens; identical to SEQ ID NO: 1027751

SEQ ID NO: 1027767 - protein, 524 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQAEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027768 - protein, 490 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEAVPSVGARFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027769 - protein, 609 aa, Homo sapiens
KFWPFALLPPFVRSHWLCCSPDQRSNRPGSSHTSMDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027770 - protein, 575 aa, Homo sapiens; identical to SEQ ID NO: 1027751

SEQ ID NO: 1027771 - protein, 575 aa, Homo sapiens; identical to SEQ ID NO: 1027751

SEQ ID NO: 1027772 - protein, 575 aa, Homo sapiens; identical to SEQ ID NO: 1027751

SEQ ID NO: 1027773 - protein, 517 aa, Homo sapiens
KFWPFALLPPFVRSHWLCCSPDQRSNRPGSSHTSMDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027774 - protein, 350 aa, Homo sapiens
KFWPFALLPPFVRSHWLCCSPDQRSNRPGSSHTSMDPRGILKAFPKRQKIHADASSKVLAKIPRREEGEEAEEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027775 - protein, 575 aa, Homo sapiens; identical to SEQ ID NO: 1027751

SEQ ID NO: 1027776 - protein, 248 aa, Homo sapiens
MEALCVCSLMPLHWSWILTASHLAAFFQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 1027777 - protein, 575 aa, Homo sapiens; identical to SEQ ID NO: 1027751

SEQ ID NO: 1027778 - protein, 229 aa, Homo sapiens
SAGSSPALLGLVPVIFVSRGGTSLRHAYFINLLPNATKGPWTNFFGDLGGGDTPKFYLLRIFRGPLKVSGYGLGRKVGSAKNVTLNHFLEEPVFFRGVPRGPCGVGKGKDLLFPVVLLFIEESFARVVLSRGFSPLLCVPVPRYQAVGSSSTTYICVPQSSDIIPFVDPFVGSPTPDGRSVRDLTKALTDPRIGVGLLPSREERETRGNKKGAHLVPGSRMGCFNEINP

SEQ ID NO: 1027779 - protein, 137 aa, Homo sapiens
VFGVISGASRAGSRHLREPWSVGRPQFARSLSAAPQLSDTADTMGFGDLKSPAGLQVLNDYLADKSYIEGYVPSQADVAVFEAVSSPPPADLCHALRWYNHIKSYEKEQGQPARSEESFGQIWSCRCGRHYRKWSYR

SEQ ID NO: 1027780 - protein, 545 aa, Homo sapiens
VFGVISGASRAGSRHLREPWSVGRPQFARSLSAAPQLSDTADTMGFGDLKSPAGLQVLNDYLADKSYIEGYVPSQADVAVFEAVSSPPPADLCHALRWYNHIKSYEKEQGQPARSEESFGQIWSCLLSAQHHSPGKLAAHSISPSMHACTISTSFAHLACMHGSATVAQPANCSAQVCKHTVMCQHIIAINTAHSPIQTPLARSCQAHSRIPIVSPQALLHTTMWDIASQATRHNWACKIYHPGKIACHMATDTLPTRRPTHGNLTTSLRSDIQFLKTTYSVTPKIWQTSTPRNILTQHHTLVHQIQHTLVCSSSSPHALAIPQQAHQVTTPKAHSLAPGDKAEQPRQLKSNMGHITWPQRHTYSDVPQECPTIGDNCIRATRRLLEQHETETTPTKQIATIHHCEHDNNCAQLTRTSSNTQKHMKQHQHNTTDNQTKHTKTRPQHHEKRNTQTTNQHAHRDTKIYDEERERRQKASSEKKAQQHKDATTRRQDGTSKRNHNGRQTNEQRRQNTIDENTPTKSQDREKKGNDTEREKTKQNEQEQ

SEQ ID NO: 1027781 - protein, 177 aa, Homo sapiens
MRQTHGDTQRHVRQKPFKQTGLALVAHLTLVPVAIRNFKKLQTTRVPARTHDQGGHTLCLAGDDPCAARTQCTSDVGANHTDLTSRRNQGRHTRSPTHPYKEATAQNPGETTYATPRQEGHTASVNKRTRATPGRGNAKTRDTQTVRIQTSNDAINHERQTRVEIPETKPDNDEANS

SEQ ID NO: 1027782 - protein, 75 aa, Homo sapiens
SGCGRSGGGGGAIGRAVTAAAEVTEERGASSLPPPPDFNAQSPARQRFSLEYTLHIYGDSECEGRLLPGSAQHFR

SEQ ID NO: 1027783 - protein, 157 aa, Homo sapiens
VRLRAQRWWWRRDRPGCNRRLSGSGWSGSGGRARREVTPQGSGGSGGSGGSRRRSGGRSSSSKTDSWRRAAAAAAGPGRVSRAEAGGGVVAAAATVTAAAAAAEVTEERGASSLPPPPDFNAQSPARQRFSLEYTLHIYGDSECEGRLLPGSAQHFR

SEQ ID NO: 1027784 - protein, 458 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKKTSLQGLQLVRQHRTSSDPYFDVEPASGAKQAPGVHDPYQDGQLSPRKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTEQAAPSVAPWLPYYMLFLLYLHFAYHKVVEGILDTLEGPNIPPIQRVPRDIPAMLPAARFPTTVLNATAKAVAVTLSVTADPTEILGQSSFPQLQRGGRLLKDSPDDMFRRWGLQLPLSCSCVSTSLMPVGTSERHKAKNSWPGLQGSAANAENGSAPLRTPPHLPLPSSLSLPHCLAKYRLGN

SEQ ID NO: 1027785 - protein, 471 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVASESLGPRRALGRKQQTNKKGPSKGGLQLVRQHRTSSDPYFDVEPASGAKQAPGVHDPYQDGQLSPRKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQAKLAPLWHAPWLPYYMLFLLYLHFAYHKVVEGILDTLEGPNIPPIQRVPRDIPAMLPAARFPTTVLNATAKAVAVTLQSQLTPTEILGQSSFPQLQRGGRLLKDSPDDMFRRWGLQLPLSCSCVSTSLMPVGTSERHKAKNSWPGLQGSAANAENGSAPLRTPPHLPLPSSLSLPHCLAKYRLGN

SEQ ID NO: 1027786 - protein, 455 aa, Homo sapiens
RRSLALSPRLECSGAISAHYKLRLPGSRHSPALASGVPGTTGAHHHAWLSFCIFSRDGSPQGTWQLQRRRRAAPEMELARNGEGSKKTSDQMWQAGKKTSLQGLQLVRQHRTSSDPYFDVEPASGAKQAPGVHDPYQDGQLSPRKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQAKLAPLWHAPWLPYYMLFLLYLHFAYHKVVEGILDTLEGPNIPPIQRVPRDIPAMLPAARFPTTVLNATAKAVAVTLQSQLTPTEILGQSSFPQLQRGGRLLKDSPDDMFRRWGLQLPLSCSCVSTSLMPVGTSERHKAKNSWPGLQGSAANAENGSAPLRTPPHLPLPSSLSLPHCLAKYRLGN

SEQ ID NO: 1027787 - protein, 538 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKKTSLQGLQLVRQHRTSSDPYFDVEPASGAKQAPGVHDPYQDGQLSPRKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTSCPLRARGYRGFQRREPSRDMATTAAPAGGARNGAGPEWGGFEENIQGGGSAVIDMENMDDTSGSSFEDMGELHQRLREEEVDADAADAAAAEEEDGEAPWLPYYMLFLLYLHFAYHKVVEGILDTLEGPNIPPIQRVPRDIPAMLPAARFPTTVLNATAKAVAVTLQSSFPQLQRGGRLLKDSPDDMFRRWGLQLPLSCSCVSTSLMPVGTSERHKAKNSWPGLQGSAANAENGSAPLRTPPHLPLPSSLSLPHCLAKYRLGN

SEQ ID NO: 1027788 - protein, 461 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKKTSLQGLQLVRQHRTSSDPYFDVEPASGAKQAPGVHDPYQDGQLSPRKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQAKLAPLWHAPWLPYYMLFLLYLHFAYHKVVEGILDTLDGPQHPAHPEGPQRHPCHAPCCSVSHHRPQRHSQSCCGDPVSRQLTPTEILGQSSFPQLQRGGRLLKDSPDDMFRRWGLQLPLSCSCVSTSLMPVGTSERHKAKNSWPGLQGSAANAENGSAPLRTPPHLPLPSSLSLPHCLAKYRLGN

SEQ ID NO: 1027789 - protein, 119 aa, Homo sapiens
HFRHRKKVARKFWWKNVKMIVLICVIVFIIILFIGLFATGAFFEVTGNLSHLPFFSGTTLHKCVPKGSPFLSSSTENAAGSSYPSSRGPVATLYAPKGPLVPRKEKKKKNGLWLHFLGP

SEQ ID NO: 1027790 - protein, 336 aa, Homo sapiens
EREQKLIPAKVNEAWVVIQSVPRGSALCAMDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPGAARPAPSTSSSPNHKGAEDRQALPTRRGPRRRLQGGEPRSSPGNLALGCLGGGAWTQGWPMAGQSPVLRIIVENLFYPVTLDVLHQIGSKFGTVLKIITFTKERTSARPCVQVCGPRELPRRPRLSRGRAEHLTTPGARCASTFQGSPGSESSTTMTGAWNTKPRPGLGEASPGDAHGRDWVRKPQT

SEQ ID NO: 1027791 - protein, 82 aa, Homo sapiens
EREQKLIPAKVNEAWVVIQSVPRGSALCAMDGIVPDIAVGTKRGSDELFSTCVTNGPFIMSSNSASVFVLFLPPRVLFRGLS

SEQ ID NO: 1027792 - protein, 277 aa, Homo sapiens
MSSNSASAANGNDSKKFKGDSRSAGVPSRVIHIRKLPIDVTEGEVISLGLPFGKVTNLLMLKGKNQAFIEMNTEEAANTMVNYYTSVTPGAARPAPSTSSSPNHKGAEDRQALPTRRGPRRRLQGGEPRSSPGNLALGCLGGGAWTQGWPMAGQSPVLRIIVENLFYPVTLDVLHQIGSKFGTVLKIITFTKERTSARPCVQVCGPRELPRRPRLSRGRAEHLTTPGARCASTFQGSPGSESSTTMTGAWNTKPRPGLGEASPGDAHGRDWVRKPQT

SEQ ID NO: 1027793 - protein, 252 aa, Homo sapiens
KHTLMKAIRGHLENNPVLELLPHIRGNVGFVFTKELTERMLLANKVPAAARAGAIAPCVTVPAQNTGGKEKYFLQLGITKSRGTIEILSDVQIKTGEKVGASEATLMNNAKTSPPSPLGWSSSRCSTMADIYNPEVLDITEETLHSRFLEGVRKCCQCLSADWLPQTVASVPHILSSTGTNESWPCLWRRITPFPLAEKVKAFLADPSAFVAAAPVAAATTAAPAAAAAPAKVEAKEESEESDEDMGFGLFD

SEQ ID NO: 1027794 - protein, 124 aa, Homo sapiens
MAGPATRAGDVGWAAFPIVTNMKLLEETGLLLTICSLEGAWVRRQAREPCVKSRVFKNFQTGTDYGRDLLAREQLTPLIKRVEPELVNFWSYFGELGPQLATQGRVQTMAFQPKLAFRPPIGQS

SEQ ID NO: 1027795 - protein, 124 aa, Homo sapiens
MAGPATRAGDVGWAAFPIVTNMKLLEETGLLLTICSLEGAWVRRQAREPCVMEKVRSPKLKAEAKFYFERSREQLTPLIKRVEPELVNFWSYFGELGPQLATQGRVQTMAFQPKLAFRPPIGQS

SEQ ID NO: 1027796 - protein, 140 aa, Homo sapiens
MECPSCQHVSKEETPKFCSQCGERLPPAAPIADSENNNSTMASASEGEMECGQELKEEGGPCLFPGSDSWQENPEEPCSKASWTVQEGATSEVLVDAAVDLISDEWEAANAIPSKRRKQDAAPLEAASVPSADCEQSSPL

SEQ ID NO: 1027797 - protein, 144 aa, Homo sapiens
GVFASLLELCVGDSPACLKGVVFQQGATSEVLVDAAVDLISDEWEAANAIPSKRRKQDAAPLEAASVPSADCEQVVRVNSLGRMLPCLVQCWTGREANSDFRALESLPVGGRLPRMGVYGSPLGCDRATRNQAGVLVTLKPQSK

SEQ ID NO: 1027798 - protein, 124 aa, Homo sapiens
MECPSCQHVSKEETPKFCSQCGERLPPAAPIADSENNNSTMASASEGEMECGQELKEEGGPCLFPGSDSWQGATSEVLVDAAVDLISDEWEAANAIPSKRRKQDAAPLEAASVPSADCEQSSPL

SEQ ID NO: 1027799 - protein, 114 aa, Homo sapiens
MECPSCQHVSKEETPKFCSQCGERLPPAAPIADSENNNSTMASASEGEMECGQELKEEGGPCLFPGSDSWQENPEEPCSKASWTVQEVSALPRLPSAPVTLRQENLTAHTARGR

SEQ ID NO: 1027800 - protein, 149 aa, Homo sapiens
MVARKSLGKLLVWVLLASKLGMWEGLCETTHGGSPKQQHPASQHWPACSDQLCRAAAAVGRGCGRSSQHWRPSGLNPVTVTMGPVFDARSRKRQAALADVSTALSQLHSPCGQPRHTSFPELSLTQIVRLLCRMQPKFPATICDAYRLI

SEQ ID NO: 1027801 - protein, 162 aa, Homo sapiens
MEVGQYGKNASRAGDRGVLLEPFIHQVGGHSSMMRYDDHTVCKPLISREQRFYESLPPEMKEFTPEYKGVVSVCFEGDSDGYINLVAYPYVESETVEQDDTTEREQPRRKHSRRSLHRSGSGSDHKEEKASLSLETSESSQEAKSPKVDAAQATQKVPFQDC

SEQ ID NO: 1027802 - protein, 162 aa, Homo sapiens; identical to SEQ ID NO: 1027801

SEQ ID NO: 1027803 - protein, 218 aa, Homo sapiens
MWKVRLWNRMTQQNGSNLGANTPAGACTGQAVAVTTRRRKPACPLRPLRATGGKRVRRLMLHRPLRRSLSRIAKCATCGLEFPETDSCHKPPWETCGVTKAGQSEPACCIPKFQRDPENVFYQGFHPCLDETVSDTNVSSGYPPVALVWGPPLKNCAQRRGKAIVAEGTADTGLDQQRSAPGQRIPGKIADGTGMAAFQGRTAVEVRTQGVLPGHCHR

SEQ ID NO: 1027804 - protein, 459 aa, Homo sapiens
LSITDNSSSSDIVESSTSYIKISNSSHSEYSSFSHAQTERSNISSYDGEYAQPSTESPVLHTSNLPSYTPTINMPNTSVVLDTDAEFVSDSSSSSSSSSSSCSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTGRVTSPASGSLGTFSFSPKQQLFPRVKTWLPNLPPLLFRAAHSHQQQCPLQPQSTAVLCTLVFTMANASQTTPAVATTAGARLPGKGMIAVWM

SEQ ID NO: 1027805 - protein, 181 aa, Homo sapiens
MDIPSSARIIPMTPPSSQSPTLLPRTGPLWNLHKPDFWSSPTSSLSLLLGAPSFLSSQGSSRSLLATKHKKQMMAGWQEEPHTQAECQVLQPPLSHSYPKQQNISRVRKVPIVNHLHHIHVAIRPSTCISGTNVDTFILSMHGTFTKINLTYFVPANLNIFESNQITQHVSDHITVLEVND

SEQ ID NO: 1027806 - protein, 160 aa, Homo sapiens
MQTILANTVKPVSTDFWSSPTSSLSLLLGAPSFLSSQGSSRSLLATKHKKQMMAGWQEEPHTQAECQVLQPPLSHSYPKQQNISRVRKVPIVNHLHHIHVAIRPSTCISGTNVDTFILSMHGTFTKINLTYFVPANLNIFESNQITQHVSDHITVLEVND

SEQ ID NO: 1027807 - protein, 83 aa, Homo sapiens
DPDHQDSDAPRHLMALDEDGTVSFPWGPVSCVALGIERMAWHFTHCMPPQIHLSPLFTASKSVALPFCPPRGLPSLVSSEVTQ

SEQ ID NO: 1027808 - protein, 83 aa, Homo sapiens; identical to SEQ ID NO: 1027807

SEQ ID NO: 1027809 - protein, 375 aa, Homo sapiens
EAEEAPGARPQLQDAWRGPREPGPAGRGDGDSGRSQREGQGEGETQEAAAAARRQEQTLRDATMEVQRGQFQGRPVSVWDVLFSSYLSEAHRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 1027810 - protein, 125 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGHLWFCRSPSARPASSHCT

SEQ ID NO: 1027811 - protein, 995 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGNPVPPWGLVSGPWVGCRSTVIRVLQTRSTFQGLRAATSQSCCGASVLRGVHPPRTAVTKPHIKAGRGCLPKTEENPRPSRLSQATGDSHPAHPQELPGLATSWSGGPGGTRAEQQVGSACPVTLPKGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 1027812 - protein, 986 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGNPVPPWGLVSGPWVGCRSTVIRVLQTRSTFQGLRAATSQSCCGASVLRGVHPPRTAVTKPHIKAGRGCLPKTEENPRPSRLSQATGDSHPAHPQELPGLATSWSGGPGGTRAEQQVGSACPVTLPKGDSDDAAPSGSGTLSSTPPSASPAAKEASPTPPSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 1027813 - protein, 657 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPTGSGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 1027814 - protein, 868 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 1027815 - protein, 888 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGNPVPPWGLVSGPWVGCRSTVIRVLQTRSTFQGLRAATSQSCCGASVLRGVHPPRTAVTKPHIKAGRGCLPKTEENPRPSRLSQATGDSHPAHPQELPGLATSWSGGPGGTRAEQQVGSACPVTPPQRRLGRRGPLGLWHALLHPAVRISCGQGGLTHPALLPVGERRPVLPQVKVPHGSARFTYPPHHMLPDSVILPYVTSTSQGTWPVSHEGGGAL

SEQ ID NO: 1027816 - protein, 675 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSAVLPA

SEQ ID NO: 1027817 - protein, 868 aa, Homo sapiens; identical to SEQ ID NO: 1027814

SEQ ID NO: 1027818 - protein, 859 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSQGVGAELMGLQVDYWTAAQPADRKRDAEKKDLPVTKNTLKCTFRSLQVSRLPSSGEAAATPTMSMTVVTKEKNKKVMFLPKKAKDKDVESKSQCIEGISRLICTARQQQNMLRVLIDGVECSDVKFFQLAAQWSSHVKHFPICIFGHSKATF

SEQ ID NO: 1027819 - protein, 860 aa, Homo sapiens
MNLFATWEVDGSSPSCVPRLCSLTLKKLVVFKELEKELISVVIAVKMQGSKRILRSHEIVLPPSGQVETDLALTFSLQYPHFLKREGNKLQIMLQRRKRYKNRTILGYKTLAAGSISMAEVMQHPSEGGQVLSLCSSIKEAPVKAAEIWIASLSSQPIDHEDSTMQAGPKAKSTDNYSEEEYESFSSEQEASDDAVQGQDLDEDDFDVGKPKKQRRSIVRTTSMTRQQNFKQKVVALLRRFKVSDEVLDSEQDPAEHIPEAEEDLDLLYDTLDMEHPSDSGPDMEDDDSVLSTPKPKLRPYFEGLSHSSSQTEIGSIHSARSHKEPPSPADVPEKTRSLGGRQPSDSVSDTVALGVPGPREHPGQPEDSPEAEASTLDVFTERLPPSGRITKTESLVIPSTRSEGKQAGRRGRSTSLKERQAARPQNERANSLDNERCPDARSQLQIPRKTVYDQLNHILISDDQLPENIILVNTSDWQGQFLSDVLQRHTLPVVCTCSPADVQAAFSTIVSRIQRYCNCNSQPPTPVKIAVAGAQHYLSAILRLFVEQLSHKTPDWLGYMRFLVIPLGSHPVARYLGSVDYRYNNFFQDLAWRDLFNKLEAQSAVQDTPDIVSRITQYIAGANCAHQLPIAEAMLTYKQKSPDEESSQKFIPFVGVVKVGIVEPSSATSGDSDDAAPSGSGTLSSTPPSASPAAKEASPTPPSSPSVSGGLSSPSQGVGAELMGLQVDYWTAAQPADRKRDAEKKDLPVTKNTLKCTFRSLQVSRLPSQGVGAELMGLQVDYWTAAQPADRKRDVESKSQCIEGISRLICTARQQQNMLRVLIDGVECSDVKFFQLAAQWSSHVKHFPICIFGHSKATF

SEQ ID NO: 1027820 - protein, 868 aa, Homo sapiens; identical to SEQ ID NO: 1027814

SEQ ID NO: 1027821 - protein, 445 aa, Homo sapiens
AGLRALLRTRTSFVPCPLDWNLLERTPGRTNPAPASTAAMSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLL

SEQ ID NO: 1027822 - protein, 160 aa, Homo sapiens
MLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLL

SEQ ID NO: 1027823 - protein, 253 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKVEGGCITKLETFIQEHLRVIGAVGIGIACVQVFGMIFTCCLYRSLKLEHY

SEQ ID NO: 1027824 - protein, 105 aa, Homo sapiens
MAVGIWTLALKSDYISLLASGTYLATAYILVVAGTVVMVTGVLGCCATFKERRNLLRLYFILLLIIFLLEIIAGILAYAYYQQAEHGAQGEPEGHHDQALPPAGP

SEQ ID NO: 1027825 - protein, 253 aa, Homo sapiens; identical to SEQ ID NO: 1027823

SEQ ID NO: 1027826 - protein, 253 aa, Homo sapiens; identical to SEQ ID NO: 1027823

SEQ ID NO: 1027827 - protein, 253 aa, Homo sapiens; identical to SEQ ID NO: 1027823

SEQ ID NO: 1027828 - protein, 139 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQAEHGAQGEPEGHHDQALPPAGP

SEQ ID NO: 1027829 - protein, 139 aa, Homo sapiens; identical to SEQ ID NO: 1027828

SEQ ID NO: 1027830 - protein, 179 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLVRRAQGHGVGVVQMGPRRLSLQALNLCLAVLTWGGVTVLPHLPSPVGPHVPAGPAEGRHQLRKKASGRVAAPQPPPGAWGAGVGTLL

SEQ ID NO: 1027831 - protein, 218 aa, Homo sapiens
MGEFNEKKTTCGTVCLKYLLFTYNCCFWLAGTSSCSSSSFCWRSSLVSSPTPTTSRLNTELKENLKDTMTKRYHQPGHEAVTSAVDQLQQEFHCCGSNNSQDWRDSEWIRSQEAGGRGGPRQLLQDGGGSLWTARPCLQHLQGGGRLHHQVGDLHPGAPEGHWGCGDRHCLCAGLWHDLHVLPVQESQAGALLTLPWALLLLHPTTELRPLSTRGWAP

SEQ ID NO: 1027832 - protein, 264 aa, Homo sapiens
MVPELTNVPLGLEMGSRSLQGHMGSGRCPGIQKLSLPLPHFIVTLVTVLAPPNLPSCRGLTSALPCGSELGPGPPHRPSWGSASPTLEGLRLRLKFPAPQPQLNTELKENLKDTMTKRYHQPGHEAVTSAVDQLQQEFHCCGSNNSQDWRDSEWIRSQEAGGRGGPRQLLQDGGGSLWTARPCLQHLQGGGRLHHQVGDLHPGAPEGHWGCGDRHCLCAGLWHDLHVLPVQESQAGALLTLPWALLLLHPTTELRPLSTRGWAP

SEQ ID NO: 1027833 - protein, 139 aa, Homo sapiens; identical to SEQ ID NO: 1027828

SEQ ID NO: 1027834 - protein, 139 aa, Homo sapiens; identical to SEQ ID NO: 1027828

SEQ ID NO: 1027835 - protein, 139 aa, Homo sapiens; identical to SEQ ID NO: 1027828

SEQ ID NO: 1027836 - protein, 139 aa, Homo sapiens; identical to SEQ ID NO: 1027828

SEQ ID NO: 1027837 - protein, 126 aa, Homo sapiens
MWHRLPQVPAVYLQLLLLAGCCSRSSTAVAATTHRTGETVSGSAHRRPVAVVVPDSCCKTVVALCGQRDHASNIYKVEGGCITKLETFIQEHLRVIGAVGIGIACVQVFGMIFTCCLYRSLKLEHY

SEQ ID NO: 1027838 - protein, 113 aa, Homo sapiens
KPTTSPCTNRLGRGSVLNRPRGGGSLWTARPCLQHLQGGGRLHHQVGDLHPGAPEGHWGCGDRHCLCAGLWHDLHVLPVQESQAGALLTLPWALLLLHPTTELRPLSTRGWAP

SEQ ID NO: 1027839 - protein, 139 aa, Homo sapiens; identical to SEQ ID NO: 1027828

SEQ ID NO: 1027840 - protein, 274 aa, Homo sapiens
RGFRPAERPPPREGLEAGAGLGPGAGAVPLVGSGPRILSAGSRRPRSCCRRRQGPDSDAWYSLESWGASVHLSCRGVVSSPAGECWPGGAEQAGRRKSRPGCAVWKRGPGAQLLSAPHALPGFPMLTAAHCCSPRMGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQAEHGAQGEPEGHHDQALPPAGP

SEQ ID NO: 1027841 - protein, 179 aa, Homo sapiens; identical to SEQ ID NO: 1027830

SEQ ID NO: 1027842 - protein, 264 aa, Homo sapiens; identical to SEQ ID NO: 1027832

SEQ ID NO: 1027843 - protein, 139 aa, Homo sapiens; identical to SEQ ID NO: 1027828

SEQ ID NO: 1027844 - protein, 139 aa, Homo sapiens; identical to SEQ ID NO: 1027828

SEQ ID NO: 1027845 - protein, 139 aa, Homo sapiens; identical to SEQ ID NO: 1027828

SEQ ID NO: 1027846 - protein, 139 aa, Homo sapiens; identical to SEQ ID NO: 1027828

SEQ ID NO: 1027847 - protein, 253 aa, Homo sapiens; identical to SEQ ID NO: 1027823

SEQ ID NO: 1027848 - protein, 253 aa, Homo sapiens; identical to SEQ ID NO: 1027823

SEQ ID NO: 1027849 - protein, 247 aa, Homo sapiens
CSIKPCQEGGVFPRARGATSVPTRVRGLSSKRPVRGALVVLGRRDPGPRKARSARLRPAGGKFFSSEWDERLEGSELKSCRMRSVCLLGQPASPAAEEAAGGSPGRPRTWAQPGAATSAAGCAHEQPGSPEGRAPRRSSLGSRSRAMCSAQATRNTIRMSTRNRRTSIIFMAARAGPGLERVLPARPSSCSWARARRRLAGQGPSVPGGYQLRGCPRARAACRAPAAGALGPRAISGPSPLGLSGAA

SEQ ID NO: 1027850 - protein, 68 aa, Homo sapiens
IQLLQMNFAKIKCNLTLQMKIEQEKEIAEKKQLNLLSQDKGVRDDGKDGGVEMKVDLTFKVVNWNVNF

SEQ ID NO: 1027851 - protein, 169 aa, Homo sapiens
MATAEPSGRALRLSTPGPRPSGARDRAPGAAGPPSGQIGNRALRLGERTPAAVEKRGPYMVTRAPSIQAKLRSVKFNKGYTALSQSPDENLVSLDSDSDGELGSRYSSGYSSAEQVNQDVSRQLLQDGYHLDEIPDDEDLDLIPPKPMASSTCSCCWCCLGDSSSCTLQ

SEQ ID NO: 1027852 - protein, 198 aa, Homo sapiens
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDSDGELGSRYSSGYSSAEQVNQDVSRQLLQDGYHLDEIPDDEDLDLIPPKPMASSTCSCCWCCLGDSSSCTLQ

SEQ ID NO: 1027853 - protein, 119 aa, Homo sapiens
GRVPRAGSGAPLGLGPGGKGLAAACSRPSKSVRKERPPSLRETRRSGEDPADPGPLTSREAPGPGQGRSAEKRHAGGLAEPPRLFREKVSAGATSSVPAALEKALIPRTEAGCSGLRPS

SEQ ID NO: 1027854 - protein, 119 aa, Homo sapiens
MATAEPSGRALRLSTPGPRPSGARDRAPGAAGPPSGQIGNRALRLGERTPAAVEKRGPYMVTRAPSIQAKLRSVKFNKGYTALSQSPDENLVSLDSDRPFMYIPGPFSSEQYPFPGWLG

SEQ ID NO: 1027855 - protein, 95 aa, Homo sapiens
VESQSSLRGEGSRARCVDKAAHHPLPLEPMLYYASPLFCYYPIFFSFDRDYVWAPSGNCQSTDFQTYWELDIYLNASGFSENRSWGSVTVKSGQY

SEQ ID NO: 1027856 - protein, 198 aa, Homo sapiens; identical to SEQ ID NO: 1027852

SEQ ID NO: 1027857 - protein, 198 aa, Homo sapiens; identical to SEQ ID NO: 1027852

SEQ ID NO: 1027858 - protein, 198 aa, Homo sapiens; identical to SEQ ID NO: 1027852

SEQ ID NO: 1027859 - protein, 198 aa, Homo sapiens; identical to SEQ ID NO: 1027852

SEQ ID NO: 1027860 - protein, 198 aa, Homo sapiens; identical to SEQ ID NO: 1027852

SEQ ID NO: 1027861 - protein, 113 aa, Homo sapiens
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSQQAPPPLCQQL

SEQ ID NO: 1027862 - protein, 127 aa, Homo sapiens
MATAEPSGRALRLSTPGPRPSGARDRAPGAAGPPSGQIGNRALRLGERTPAAVEKRGPYMVTRAPSIQAKLQKHRDLAKAVLRRKGMLGASPNRPDSSGKRSVKFNKGYTALSQSPDENLVSLDSDR

SEQ ID NO: 1027863 - protein, 198 aa, Homo sapiens; identical to SEQ ID NO: 1027852

SEQ ID NO: 1027864 - protein, 169 aa, Homo sapiens; identical to SEQ ID NO: 1027851

SEQ ID NO: 1027865 - protein, 198 aa, Homo sapiens; identical to SEQ ID NO: 1027852

SEQ ID NO: 1027866 - protein, 198 aa, Homo sapiens; identical to SEQ ID NO: 1027852

SEQ ID NO: 1027867 - protein, 198 aa, Homo sapiens; identical to SEQ ID NO: 1027852

SEQ ID NO: 1027868 - protein, 370 aa, Homo sapiens
MSHPSPQAKPSNPSNPRVFFDVDIGGERVGRIVLELFADIVPKTAENFRALCTGEKGIGHTTGKPLHFKGCPFHRIIKKFMIQGGDFSNQNGTGGESIYGEKFEDENFHYKHDREGLLSMANAGRNTNGSQFFITTVPTPHLDGKHVVFGQVIKGIGVARILENVEVKGEKPAKLCVIAECGELKEGDDGGIFPKDGSGDSHPDFPEDADIDLKDVDKILLITEDLKNIGNTFFKSQNWEMAIKKYAEVLRYVDSSKAVIETADRAKLQPIALSCVLNIGACKLKMSNWQGAIDSCLEALELDPSNTKALYRRAQGWQGLKEYDQALADLKKAQGIAPEDKAIQAELLKVKQKIKAQKDKEKAVYAKMFA

SEQ ID NO: 1027869 - protein, 113 aa, Homo sapiens
MSHPSPQAKPSNPSNPRVFFDVDIGGERVGRIVLELFADIVPKTAENFRALCTGEKGIGHTTGKPLHFKGCPFHRIIKKFMIQGGDFSNQNGTGGESIYGEKFEDENFHYKVK

SEQ ID NO: 1027870 - protein, 370 aa, Homo sapiens; identical to SEQ ID NO: 1027868

SEQ ID NO: 1027871 - protein, 370 aa, Homo sapiens; identical to SEQ ID NO: 1027868

SEQ ID NO: 1027872 - protein, 336 aa, Homo sapiens
VLTMGCDGGTIPKRHESGEVGRRRLRLSTKMLNYWPNGTIVLLSPGNIKTTNSCHVNLAALYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIVLNGTKEDVDVLKTRMEERRLRAKLEKKTKKPKAAESVSKPDVSAERKLEKKTKKPKAAESVSKPDVSEEAPGPSKVKTGKPEEASLDSREKKTNLAPKSTAMNEKLFWKSWEASDVDATKRSIADSEESEAYKSLFTTHSSAKRSKEESAHWVTHTSYRF

SEQ ID NO: 1027873 - protein, 313 aa, Homo sapiens
VLTMGCDGGTIPKRHESGEVGRRRLRLSTKMLNYWPNGTIVLLSPGNIKTHQIVAMCNLAALYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIVLNGTKEDVDVLKTRMEERRLRAKLDKKTKKPKAAESVSKPDVSEEAPGPSKVKTGKPEEASLDSREKKTNLAPKSTAMNEKLFWKSWEASDVDATKRSIADSEESEAYKSLFTTHSSAKRSKEESAHWVTHTSYRF

SEQ ID NO: 1027874 - protein, 192 aa, Homo sapiens
CPHAASFYSELFTLYLLLHEREDSFYSQGIANLSLFPDTQLLEFLDVQKHLWPLKDLTLTSNQRYSLVRDKCFLSATECLQKIMTTVDPREKLEVLERTYGEIEGTVSRVLGREYKLPMDDLLPLLIYVVSRARIQHLGAEIHLIRDMMDPNHTGGLYDFLLTALESCYEHIQKEDMRLHRLPGHWHSRELW

SEQ ID NO: 1027875 - protein, 290 aa, Homo sapiens
CPHAASFYSELFTLYLLLHEREDSFYSQGIANLSLFPDTQLLEFLDVQKHLWPLKDLTLTSNQRYSLVRDKCFLSATECLQKIMTTVDPREKLEVLERTYGEIEGTVSRVLGREYKLPMDDLLPLLIYVVSRARGGSQELGVQAGAGSHPQPRYLLIPLNPRFMDAASLCTDGEAKAQKRRVPARCWGARGRVRTTPQVSSHPGQRSFPSCLSATGLFSLSPSSLGGAVFSRIQHLGAEIHLIRDMMDPNHTGGLYDFLLTALESCYEHIQKEDMRLHRLPGHWHSRELW

SEQ ID NO: 1027876 - protein, 162 aa, Homo sapiens
SYLWRRGLRPALGRGDVRAGGPWPHPATPSTMQRYSLVRDKCFLSATECLQKIMTTVDPREKLEVLERTYGEIEGTVSRVLGREYKLPMDDLLPLLIYVVSRARIQHLGAEIHLIRDMMDPNHTGGLYDFLLTALESCYEHIQKEDMRLHRLPGHWHSRELW

SEQ ID NO: 1027877 - protein, 82 aa, Homo sapiens
VHYSPFLPSLRNVDDAGVEHWGLDEPLLKHWEFDAPSPLPQTTENVVCALGLTVGLVGIIIGTIFIIKGVRKSNAAERRGPL

SEQ ID NO: 1027878 - protein, 82 aa, Homo sapiens; identical to SEQ ID NO: 1027877

SEQ ID NO: 1027879 - protein, 76 aa, Homo sapiens
QKENVVLLPPGALKLLVSVVPSYLWSFPKGKMPTKRMEETQGASVRHMEVMVFLREKITEETSALMTLQSWQYYNP

SEQ ID NO: 1027880 - protein, 82 aa, Homo sapiens; identical to SEQ ID NO: 1027877

SEQ ID NO: 1027881 - protein, 82 aa, Homo sapiens; identical to SEQ ID NO: 1027877

SEQ ID NO: 1027882 - protein, 76 aa, Homo sapiens; identical to SEQ ID NO: 1027879

SEQ ID NO: 1027883 - protein, 183 aa, Homo sapiens
GWWGGESSPFLVLRDSHPSSEGAGCPARDGPIIPSPGTHRPHVSLGTALASLNFWPPCAFRKVLSDDMKKLKARMHQAIERFYDKMPNAESGRGQVMSSLAELEDDFKEGYLETVAAYYEEQHPELTPLLEKERDGLRCRGYRSPVPDLEDPAPRSLGRAVVNQVTEMVPALLLVSALMLVLS

SEQ ID NO: 1027884 - protein, 139 aa, Homo sapiens
MSAGLGSLNFWPPCAFRKVLSDDMKKLKARMHQAIERFYDKMQNAESGRGQVMSSLAELEDDFKEGYLETVAAYYEEQHPELTPLLEKERDGLRCRGYRSPVPDLEDPAPRSLGRAVVNQVTEMVPALLLVSALMLVLS

SEQ ID NO: 1027885 - protein, 127 aa, Homo sapiens
MSFQNNVLRTIGEVAIKTIFPLQTGVGTLANAILFFHNIFPILTEHQMRPTHKILTHMAVANSLVLLSTGIPHTMVSFVLWKPLSSLECKLVFTGLVLTWCSARVDLPRCWNYRREPPLLAYASILS

SEQ ID NO: 1027886 - protein, 117 aa, Homo sapiens
MTALMESTEYFRFSPGPLESGCTHGICFDPGDVRGSEACHHEAEELGAIEMGHSLLHLLEQLTAPIWRLLLYSRGRMRACGAQGTGEPWRMCSMGRKRAFSGVHFHSLGLFLTYSDT

SEQ ID NO: 1027887 - protein, 125 aa, Homo sapiens
MEDILFPRSGLHSYWGPLKCTMGVASPAYFAENPRTFDLLSPEEYLILCQNLLSSPVKTIPVLFDLSQMGKTWCRIREQCIVVNPWLESWSTEHHRSFIHAGWPRLNRIKTSLADFSAVIMGSSV

SEQ ID NO: 1027888 - protein, 59 aa, Homo sapiens
MPQTLSVLVLAGAHEHANGLIPTPFQGQLRTSHVRHKYWTSPNDISYSPTQFSDQSVRM

SEQ ID NO: 1027889 - protein, 697 aa, Homo sapiens [sequence omitted]

SEQ ID NO: 1027890 - protein, 678 aa, Homo sapiens
MDDPDCDSTWEEDEEDAEDAEDEDCEDGEAAGARDADAGDEDEESEEPRAALAQLVPVQNDRVQKRGEPRGDMCRYRHNYPDLVERDCNGDTPNLSFYRNEIRFLPNGCFIEDILQNWTDNYDLLEDNHSYIQWLFPLREPGVNWHAKPLTLREVEVFKSSQEIQERLVRAYELMLGFYGIRLEDRGTGTVGRAQNYQKRFQNLNWRSHNNLRITRILKSPCELSLEHFQAPLVRFFLEETLVRRELPGVRQSALDYFMFAVRCRHQRRQLVHFAWEHFRPRCKFVWGPQDKLRRFKPSSLPHPLEGSRKVEEEGSPGDPDHEASTQGRTCEPEHSKGGGRVDEGPQPRSVEPQDAGPLERSQGDEAGGHGEDRPEPLSPKESKKRKLELSRREQPPTGPGPQSASEVEKIALNLEGCALSQGSLRTGTQEVGGQDPGEAVQPCRQPLGAKVADKVRKRRKVDEGTGDSAAVASGGAQTLALAGSPAPSGHPKAGHSENGVEEDTEGRTGPKEGTPGSPSETPGPSPAGPAGDEPAESPSETPGPRPAGPAGDEPAESPSETPGPRPAGPAGDEPAKIPSETPGPSPAGPTRDEPAESPSETPGPRPAGPAGDEPAESPSETPGPRPAGPAGDEPAESPSETPGPSPAGPTRDEPAKAGEAAELQDAEVESSAKSGKP

SEQ ID NO: 1027891 - protein, 107 aa, Homo sapiens
MDPLRAQQLAADSEVEMMADMYNRMTSACHRKCVPPHYKEAELSKGESVCLDRCVSKYLDIHERIGKKLQNWLCRMKSLLRCPTLGPDEGPFNIPPGGLSPPPSHFN

SEQ ID NO: 1027892 - protein, 218 aa, Homo sapiens
LIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKTEGLGNYSIHLVEVDTQGLSLKLLGTEASTCCPFP

SEQ ID NO: 1027893 - protein, 154 aa, Homo sapiens
MPSPEVSVQEEGLLSGLDGPLPCCPGFGEAIPELVLGLPHPVLSTAHRVLAPSLLAAVGAASLTLVTARSATPLQEVTHVSSLALTAAGPQASEFWMLPCGSNRHRLPFRRWRGRFPQASELCAGAVAMGRCSTLPPPRVFLGNTLECLSEGPA

SEQ ID NO: 1027894 - protein, 101 aa, Homo sapiens
KVVTFCDYAYNTFRSPRCMSSAEEGPKRRGGGGKENQFFLQATDKNSLLGMEGANSIFSGFLLFSRYGGLTCGLLHIHPGSPCQQRSLYPQHHPLPSQCTQ

SEQ ID NO: 1027895 - protein, 137 aa, Homo sapiens
PVRDPKGFLQQHILKGLGAVGQDAGHSADETIGVVHLVLRRLLQEQHQLSSRSEERGKGWAGITQHNGSASRLAVLWATPHTASLSSVCAVAGKNERTHREKTVSREGDAWGWKKEALCLPRGWKELLCSLHSPLPG

SEQ ID NO: 1027896 - protein, 172 aa, Homo sapiens
RTSACALGGAGRAGAGCERTASAGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDWDASPGHGTGIGT

SEQ ID NO: 1027897 - protein, 138 aa, Homo sapiens
PIWPGGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDWSRS

SEQ ID NO: 1027898 - protein, 268 aa, Homo sapiens
SGHPPARWAGRGGLGRAVSGPRALGGSAARSVGACSRAVWRSECLAGVPRTSCGPALPRSCGGRAARPILSGGGRLALGCRRGGVGEGRPSPGSSALIVGSPVPGGPSAGDSGSDTGRPGRGSGDSGDPLLTLREFLCTVVGAGPRGVECGRGREVWCLEGGYRFRPDKHLELVWPSCLSNGAISSLRRGGLASPQTSKPIGWMPWISEGRATRPCLRVPSARRGDEGLHQRGTDRQQGVGYRVGGRRVGPGMRSKPVASVVSVESQL

SEQ ID NO: 1027899 - protein, 111 aa, Homo sapiens
REGPPDHRDGGGGGLDQFRAAARRPPPSRTRRPSSVLPPSSWRTGGEAKAPPPRDRSALPPPPALPRPPLSSSVGTCLLLTNGLPPTPVTHRKAKILITCSTLISIRKPSS

SEQ ID NO: 1027900 - protein, 247 aa, Homo sapiens
RTSACALGGAGRAGAGCERTASAGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKNKDSG

SEQ ID NO: 1027901 - protein, 201 aa, Homo sapiens
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKNKDSG

SEQ ID NO: 1027902 - protein, 201 aa, Homo sapiens; identical to SEQ ID NO: 1027901

SEQ ID NO: 1027903 - protein, 665 aa, Homo sapiens
MNLEKLSKPELLTLFSILEGELEARDLVIEALKAQHRDTFIEERYGKYNISDPLMALQRDFETLKEKNDGEKQPVCTNPLSILKVVMKQCKNMQERMLSQLAAAESRHRKVILDLEEERQRHAQDTAEGDDVTYMLEKERERLTQQLEFEKSQVKKFEKEQKKLSSQLEEERSRHKQLSSMLVLECKKATNKAAEEGQKAGELSLKLEKEKSRVSKLEEELAAERKRGLQTEAQVEKQLSEFDIEREQLRAKLNREENRTKTLKEEMESLKKIVKDLEASHQHSSPNEQLKKPVTVSKGTATEPLMLMSVFCQTESFPAERTHGSNIAKMTNTGLPGPATPAYSYAKTNGHCDPEIQTTRELTAGNNVENQVPPREKSVALAQEKPVENGGCPVGIETPVPMPSPLSSSGSSLSPSSTASSSLTSSPCSSPVLTKRLLGSSASSPGYQSSYQVGINQRFHAARHKFQSQADQDQQASGLQSPPSRDLSPTLIDNSAAKQLARNTVTQVLSRFTSQQGPIKPVSPNSSPFGTDYRNLANTANPRGDTSQFTYSRESVQSPEPPCLQESSPQPSPELREETLQPIPPKKPGLTAFSICYHSIDQNSFPGSLFDHMQKTLPGSCSSNTVVANGKDVDVTFAYQQLVPRRESPRFDSSIRFRPKAQSDF

SEQ ID NO: 1027904 - protein, 161 aa, Homo sapiens
MVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKNKDSG

SEQ ID NO: 1027905 - protein, 111 aa, Homo sapiens; identical to SEQ ID NO: 1027899

SEQ ID NO: 1027906 - protein, 201 aa, Homo sapiens; identical to SEQ ID NO: 1027901

SEQ ID NO: 1027907 - protein, 222 aa, Homo sapiens
PIWPGGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKNKDSG

SEQ ID NO: 1027908 - protein, 185 aa, Homo sapiens
RTSACALGGAGRAGAGCERTASAGRVRGAVGRRLFSGCLADEASQKMSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDWYAPPCPGICICLLNILHKFIDSVNE

SEQ ID NO: 1027909 - protein, 126 aa, Homo sapiens
RTSACALGGAGRAGAGCERTASAGRVRGAVGRRLFSGCLADEASQKMSKQQPTQFINPETPGYVGFANLPNQVHRKSVKKGFEFTLMVVGESGLGKSTLINSLFLTDLYPERVIPGAAGKNILMLL

SEQ ID NO: 1027910 - protein, 197 aa, Homo sapiens
MPWISEGRATRPCLRVPSARRGDEDEASQKMSTKLHKRCLESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKNKDSG

SEQ ID NO: 1027911 - protein, 193 aa, Homo sapiens
SGHPPARWAGRGGLGRAVSGPRALGGSAARSVGACSRAVWRSECLAGVPRTSCGPALPRSCGGRAARPILSGGGRLALGCRRGGVGEGRPSPGSSALIVGSPVPGGPSAGDSGSDTGRPGRGSGDSGDPLLTLREFLCTVVGAGPRGVECGRGREVWCLEGGYRFRPDKHLELVWPSCLSRQTLRACVAILSF

SEQ ID NO: 1027912 - protein, 665 aa, Homo sapiens; identical to SEQ ID NO: 1027903

SEQ ID NO: 1027913 - protein, 665 aa, Homo sapiens; identical to SEQ ID NO: 1027903

SEQ ID NO: 1027914 - protein, 266 aa, Homo sapiens
SCLRSAQAGVGPGWPRGQGLSFGHWRARFGPLVVACAGSPVRAITGRVWSFGLCIISPGGLESCRSGGKGPVRSCAWQAIPRFGPVTPIDGRGHWSLPWTSVQVSNQFSCMSPQGRFFAVFTFIQNGFISLYFLSAQGLHGTPEVNEEALMDRNLCFRPGSSGFLGTFPGKQHFCRKWREGILVGWRSLSSSECVVVATLICWRNQPTFGCCRPNFSLGPNRPRNSCFDLTPTHNPGKPQQNSVSSQKVRPEAASVSLPAFAVPLL

SEQ ID NO: 1027915 - protein, 201 aa, Homo sapiens; identical to SEQ ID NO: 1027901

SEQ ID NO: 1027916 - protein, 201 aa, Homo sapiens; identical to SEQ ID NO: 1027901

SEQ ID NO: 1027917 - protein, 161 aa, Homo sapiens; identical to SEQ ID NO: 1027904

SEQ ID NO: 1027918 - protein, 201 aa, Homo sapiens; identical to SEQ ID NO: 1027901

SEQ ID NO: 1027919 - protein, 223 aa, Homo sapiens
MPWISEGRATRPCLRVPSARRGDEEQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKNKDSG

SEQ ID NO: 1027920 - protein, 665 aa, Homo sapiens; identical to SEQ ID NO: 1027903

SEQ ID NO: 1027921 - protein, 206 aa, Homo sapiens
RTSACALGGAGRAGAGCERTASAGRVRGAVGRRLFSGCLAETKLHKRCLESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKNKDSG

SEQ ID NO: 1027922 - protein, 665 aa, Homo sapiens; identical to SEQ ID NO: 1027903

SEQ ID NO: 1027923 - protein, 31 aa, Homo sapiens
MLCCVCCVRVCCVRVCVLCVHVCAVSVCVYM

SEQ ID NO: 1027924 - protein, 100 aa, Homo sapiens
CVLAVGGGGGASRRFEIRRVREAGRILRRVGVGAGCSAAIVRVGVCARLEGSARGFLFLLLRGCSSGLRPDPAPMASEELQKDLEEVKVLLEKATRKKST

SEQ ID NO: 1027925 - protein, 168 aa, Homo sapiens
LTPRLLSVRFRGGAPQALTLRLPVTIKFFQPTEMAAQDFFQRWKQLSLPQRAQFFNALPLDADVTAKLLGFGSALLDNVAPPENFVGAGFIQTKALQVGFKISAGAQCPGPVPAAPAPQQGALLPSPVCAAGTAVLSPGLCPGGCGRHWAAPWTEAVLVDGGPPLVTE

SEQ ID NO: 1027926 - protein, 66 aa, Homo sapiens
MKNDASVHRSFIHLPKTESNPDTLSTGQMGKQTAAHRFHKTALSRRQDWATDAGGSGDKPEMSYAE

SEQ ID NO: 1027927 - protein, 79 aa, Homo sapiens
ELRTQSVKILKGEAPPAFFNFSNQEWQVNPLLAAIRIPHQAGIQAGASTPTNATAASDANTGDRGQTNNAASASASNST

SEQ ID NO: 1027928 - protein, 109 aa, Homo sapiens
MPTESKNGTDRDEKPGDRREGNRRSERNTEGTGKKQVERNGEHRRKQGHEKKTKGSTKQERETETRATKKQSDRRTERTEENKKHTTDTERRPKEEERKKRRRRKDNAE

SEQ ID NO: 1027929 - protein, 194 aa, Homo sapiens
MPASLLAGVKGAGISEVSWAESPEWEEVAGRGSEEENRGPGGLCFFPDTGAVEETSAADARGATRPRQSWDLGLSCCASIVGALETGGPPEAPVASEDKVWEGREGLQSEMALSSTCSALLMRWNAASFSRCRSSAVTRYPSSKGGGSIKGSPRLRGSRGILRLRGLEAWDLGEPPLGASVCPGAVSAAFSHRV

SEQ ID NO: 1027930 - protein, 274 aa, Homo sapiens
MLELELALRLRQDLVREVWDLWLYLTSDLWARAAAVAEAKKCEGPPSTALSSDPDVGFNVEGGGAAAAAAGAEVPGLVLLMPASLLAAVKVAGISEVTWAESREWEEVAGRGSEEENRGPGGLCFFPDTGAVEETSAADARGATRPRQSWDLGLSCCASIVGALETGGPPEAPVASEDKVWEGREGLQSEMALSSTCSALLMRWNAASFSRCRSSAVTRYPSSKGGGSIKGSPRLRGSRGILRLRGLEAWDLGEPPLGASVCPGAVSAAFSHRV

SEQ ID NO: 1027931 - protein, 115 aa, Homo sapiens
LERGSDFIDRFVMDEPFDEHLQVEKSWMYVAKGYARESHFRGLQNVHVFENSVEDILSKKGCQQGQGGPGPCARPVRKENKETFDHQCREKGVLRPTLIPAPTVTPTTTLTVPVT

SEQ ID NO: 1027932 - protein, 327 aa, Homo sapiens
SEKNKMESWNWVLVFGCILVRMSEDNMIDMVTYMLDCYKIVETLIQLWFFSDEEDKGERTLVGDKEQAVPNIEYLLPNIWQDSAPWRPGVSGPVGDLKDSTTCSSAKSKGSWAPKKEPYAREMLAISFISAVNRKRKKRREARGLGSSTDDDSEQEAHKPGAGATAPGTQERPLGPLPGAVAPEAPGRLSPPAAPEERPAADTRSIVSGYSTLSTMDRSVCSGASGRRAGAGDEADDERSELSHVETDTEGAAGAGPGGRLTRRPSFSSHHLMPCDTLARRRLARGRPDGEGAGRGGPRAPEPPGSASSSSQESLRPPAAALASRPS

SEQ ID NO: 1027933 - protein, 183 aa, Homo sapiens
MEPEEGTPLWRLQKLPAELGPQLLHKIIDGICGRAYPVYQDYHTVWESEEWMHVLEDIAKFFKAIVGKNLPDEEIFQQLNQLNSLHQETIMKCVKSRKDEIKQALSREIVAISSAQLQDFDWQVKLALSSDKIAALRMPLLSLHLDVKENGEVKPYSIEMSREELQNLIQSLEAANKVVLQLK

SEQ ID NO: 1027934 - protein, 123 aa, Homo sapiens
MEPEEGTPLWRLQKLPAELGPQLLHKIIDGICGRAYPVYQDYHTVWESEEWMHVLEDIAKFFKAIVGKNLPDEEKYLSEDMKILGCILEKLDCFSLHIMLLMHFELIFVYGVEVKFTIFYINI

SEQ ID NO: 1027935 - protein, 183 aa, Homo sapiens; identical to SEQ ID NO: 1027933

SEQ ID NO: 1027936 - protein, 183 aa, Homo sapiens; identical to SEQ ID NO: 1027933

SEQ ID NO: 1027937 - protein, 183 aa, Homo sapiens; identical to SEQ ID NO: 1027933

SEQ ID NO: 1027938 - protein, 183 aa, Homo sapiens; identical to SEQ ID NO: 1027933

SEQ ID NO: 1027939 - protein, 183 aa, Homo sapiens; identical to SEQ ID NO: 1027933

SEQ ID NO: 1027940 - protein, 183 aa, Homo sapiens; identical to SEQ ID NO: 1027933

SEQ ID NO: 1027941 - protein, 306 aa, Homo sapiens
GGAEPATAQTSCQPRLLVRSGSGHGLTKFQLPCVPLDSLHAAVLDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKMRAASCAWAHVVSACWSGSAKTVQASCDPSAVVAASGKELEVSWV

SEQ ID NO: 1027942 - protein, 584 aa, Homo sapiens
GGAEPATAQTSCQPRLLVRSGSGHGLTKFQLPCVPLDSLHAAVLDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAAWPSVRPARPRRPRRTACPTPAPRLPRPPMRRRRQRGAREPGTAASPIRGRGGEIPHATERVLRGCAAGFLEGSEVRLQPLRAGVDASQPPSQTCGLTAGPVPRLERTLWSARQRRWESALASPSEFLMLICRCEVSRFFL

SEQ ID NO: 1027943 - protein, 535 aa, Homo sapiens
GGAEPATAQTSCQPRLLVRSGSGHGLTKFQLPCVPLDSLHAAVLDDGGWTPMIWATEYKHVDLVKLLLSKGSDINIRDNEENICLHWAAFSGCVDIAEILLAASASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAAWPSVRPARPRRPRRTACPTPAPRLPRPPMRRRRQRGAREPGTAASPIRGRGGEIPHATERVLRGCAAGFLEGSEVRLQPLRAGVDASQPPSQTCGLTAGPVPRLERTLWSARQRRWESALASPSEFLMLICRCEVSRFFL

SEQ ID NO: 1027944 - protein, 638 aa, Homo sapiens
AESLAEGERPAASTLESQAVWDLAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAAWPSVRPARPRRPRRTACPTPAPRLPRPPMRRRRQRGAREPGTAASPIRGRGGEIPHATERVLRGCAAGFLEGSEVRLQPLRAGVDASQPPSQTCGLTAGPVPRLERTLWSARQRRWESALASPSEFLMLICRCEVSRFFL

SEQ ID NO: 1027945 - protein, 809 aa, Homo sapiens
AESLAEGERPAASTLESQAVWDLAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAAWPMLSCAMLRAHVRAHVDVTRPLPQNSQGSQPGLPAQTTPILMTAGPGQAVWAASGRSPSGTAGQRDPHSTLRPGTAWDCDGNNSPATSQTTGQRGVPLSAGSHAGLPWRLIPLGHARVLGHAVDSCQAKAPTWPVCPSPQLGTWPHSPNDTNPFHPKEPFGGGPSTTGSRGAKRCRPTTEPMAKRQPTEPSSGGSQDRPDPPTEQAIGANGSPRPPTGARYQPNPSSCTASHPWKVARLDHLTGTHDHSARNYPLSSSTRHYRPVFPPSLAQPPFHLDMGSHTPLVQSANPQPVVRALLSSSTVIIHLHV

SEQ ID NO: 1027946 - protein, 156 aa, Homo sapiens
AESLAEGERPAASTLESQAVWDLAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNDDGTMKRGALSRQKEEKREAEEP

SEQ ID NO: 1027947 - protein, 638 aa, Homo sapiens; identical to SEQ ID NO: 1027944

SEQ ID NO: 1027948 - protein, 638 aa, Homo sapiens; identical to SEQ ID NO: 1027944

SEQ ID NO: 1027949 - protein, 638 aa, Homo sapiens; identical to SEQ ID NO: 1027944

SEQ ID NO: 1027950 - protein, 249 aa, Homo sapiens
ISAAVVVGGCVSCTLCVCVCVCVCVCVRVTLLVPASVRSRFLCVHTMPLLCSSQENQHVSYIHDAAVLRRGRDERASVSLDVLVSSIMCDYQKSNFVLSAYCKIHTKCRHSSAAWPRDGPTDRAQEGPGGLALGTETMFRRVATPLVHTPSGPAVAAPREATGSSRRLTELDRETRRRDSARNRKGPSGLRRRLPGGVGGEAAAPAGGCGCLPATFPDLRPHRGPSAQAGAHTLVRAPETLGVRTGITF

SEQ ID NO: 1027951 - protein, 158 aa, Homo sapiens
AESLAEGERPAASTLESQAVWDLAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEGSRGQKWEVQPQINPLNLIIRKKI

SEQ ID NO: 1027952 - protein, 331 aa, Homo sapiens
PAVLLWTVVFIWFWSGRDCVTDFDTPPILEAGAALCALPDELPLVKAGPGPSSRKPLTLHLLLIKTFVCAPLLVPELHSARGGVAYRFLVHQTPKQRPKSSQDGEVYCIDARFYGNVSRFINHHCEPNLVPVRVFMAHQDLRFPRIAFFSTRLIEAGEQLGFDYGERFWDIKGKLFSCRCGSPKCRHSSAAWPSVRPARPRRPRRTACPTPAPRLPRPPMRRRRQRGAREPGTAASPIRGRGGEIPHATERVLRGCAAGFLEGSEVRLQPLRAGVDASQPPSQTCGLTAGPVPRLERTLWSARQRRWESALASPSEFLMLICRCEVSRFFL

SEQ ID NO: 1027953 - protein, 291 aa, Homo sapiens
RRPASSTEGTGSREQSRSRSSRQQQQPSPFAERSRAGHGVVDAAEWARRRRTKSPSSSSSSRLAVMVESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 1027954 - protein, 291 aa, Homo sapiens; identical to SEQ ID NO: 1027953

SEQ ID NO: 1027955 - protein, 291 aa, Homo sapiens; identical to SEQ ID NO: 1027953

SEQ ID NO: 1027956 - protein, 291 aa, Homo sapiens; identical to SEQ ID NO: 1027953

SEQ ID NO: 1027957 - protein, 291 aa, Homo sapiens; identical to SEQ ID NO: 1027953

SEQ ID NO: 1027958 - protein, 291 aa, Homo sapiens; identical to SEQ ID NO: 1027953

SEQ ID NO: 1027959 - protein, 291 aa, Homo sapiens; identical to SEQ ID NO: 1027953

SEQ ID NO: 1027960 - protein, 396 aa, Homo sapiens
PGQVEAGAATWPAPRGAAGEEVSVCEPAAAPGLAPGRAGGDLAAPGEPGGRERTGIQTASPAREPVRSALEKKEMGVGVEKVVATPPSGEPRPLQCLARPRAPHILSFTHSLAQCRRHHPAQSHRSTHTHHTETGTGLSPCEQIVTTPGAQRHGHKEETRVGPRGKREAVCGCSGEHVEVTWSQCQGKLMENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRVSLPSSPVPASPASSSGADQRLPSQSLSSKQKGHTWALETDSASATVLGQDL

SEQ ID NO: 1027961 - protein, 258 aa, Homo sapiens
GPRRDPDPGPTGGHSAGQPRAERSRLRHRCAWWPDSKWDRRTRSLACQGKLMENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRVSLPSSPVPASPASSSGADQRLPSQSLSSKQKGHTWALETDSASATVLGQDL

SEQ ID NO: 1027962 - protein, 258 aa, Homo sapiens; identical to SEQ ID NO: 1027961

SEQ ID NO: 1027963 - protein, 514 aa, Homo sapiens
MASPGKPGADEAQEEEGELEGGSAGPRAAILEQAEELFLLCDKEAKGFITKHDLQGLQSDLPLTPEQLEAVFESLDQAHTGFLTAREFCLGLGMFVGVASAQGANPCRTPEETFESGGLDVQGTAGSLDEEEEEEERFHTVLEQLGVAPVLGEQRAVRTLWARLQRERPELLGSFEDVLIRASACLEEAARERDGLEQALRRRESEHEREVRALYEETEQLREQSRRPPSQNFARGERRSRLELELQIREQDLERAGLRQREVSTRPLPCPHGHPCTLPLCLSVPGLSGAWGTRSTPGKRGRSSPVSILSTLQLEQQLHAQAAEHLEAQAQNSQLWRAHEALRTQLEGAQEQIRRLESEARGRQEQTQQVPWDGAGRAPVRVPGAGPTGAQVWATFIPISSPRPAPWEGGSSRGSGGSPRSLPAAGSPPPIHRDVVAVSRNMQKEKVSLLRQLELLRELNTRLRDDRDACEARRAGSSCRKALTTARLPGPTCCCCCCWARPPRRGSGHLPSAR

SEQ ID NO: 1027964 - protein, 514 aa, Homo sapiens; identical to SEQ ID NO: 1027963

SEQ ID NO: 1027965 - protein, 514 aa, Homo sapiens; identical to SEQ ID NO: 1027963

SEQ ID NO: 1027966 - protein, 399 aa, Homo sapiens
MASPGKPGADEAQEEEGELEGGSAGPRAAILEQAEELFLLCDKEAKGFITKHDLQGLQSDLPLTPEQLEAVFESLDQAHTGFLTAREFCLGLGMFVGVASAQGANPCRTPEETFESGGLDVQGTAGSLDEEEEEEERFHTVLEQLGVAPVLGEQRAVRTLWARLQRERPELLGSFEDVLIRASACLEEAARERDGLEQALRRRESEHEREVRALYEETEQLREQSRRPPSQNFARGERRSRLELELQIREQDLERAGLRQRELEQQLHAQAAEHLEAQAQNSQLWRAHEALRTQLEGAQEQIRRLESEARGRQEQTQRDVVAVSRNMQKEKVSLLRQLELLRELNTRLRDDRDACEARRAGSSCRKALTTARLPGPTCCCCCCWARPPRRGSGHLPSAR

SEQ ID NO: 1027967 - protein, 213 aa, Homo sapiens [sequence omitted]

SEQ ID NO: 1027968 - protein, 514 aa, Homo sapiens; identical to SEQ ID NO: 1027963

SEQ ID NO: 1027969 - protein, 514 aa, Homo sapiens; identical to SEQ ID NO: 1027963

SEQ ID NO: 1027970 - protein, 514 aa, Homo sapiens; identical to SEQ ID NO: 1027963

SEQ ID NO: 1027971 - protein, 343 aa, Homo sapiens
MASPGKPGADEAQEEEGELEGGSAGPRAAILEQAEELFLLCDKEAKGFITKHDLQGLQSDLPLTPEQLEAVFESLDQAHTGFLTAREFCLGLGMFVGVASAQGANPCRTPEETFESGGLDVQGTAGSLDEEEEEEERFHTVLEQLGVAPVLGEQRAVRTLWARLQRERPELLGSFEDVLIRASACLEEAARERDGLEQALRRRESEHEREVRALYEETEQLREQSRRPPSQNFARGERRSRLELELQIREQDLERAGLRQRGDVVAVSRNMQKEKVSLLRQLELLRELNTRLRDDRDACEARRAGSSCRKALTTARLPGPTCCCCCCWARPPRRGSGHLPSAR

SEQ ID NO: 1027972 - protein, 390 aa, Homo sapiens
MASPGKPGADEAQEEEGELEGGSAGPRAAILEQAEELFLLCDKEAKGFITKHDLQGLQSDLPLTPEQLEAVFESLDQAHTGFLTAREFCLGLGMFVGVASAQGANPCRTPEETFESGGLDVQGTAGSLDEEEEEEERFHTVLEQLGVAPVLGEQRAVRTLWARLQRERPELLGSFEDVLIRASACLEEAARERDGLEQALRRRESEHEREVRALYEETEQLREQSRRPPSQNFARGERRSRLELELQIREQDLERAGLRQRELEQQLHAQAAEHLEAQAQNSQLWRAHEALRTQLEGAQEQIRRLESEARGRQEQTQRDVVAVSRNMQKEKVSLLRQLELLRELNTRLRDDRDACLGPPAAAAVAGLGPPDAALATFPVPGDQPRVTHGP

SEQ ID NO: 1027973 - protein, 670 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSTVGGQLPGLHEYGAVGGSTHTATAAMWACQHCTFMNQPGTGHCEMCSLPRT

SEQ ID NO: 1027974 - protein, 2323 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPAPSCILAGAIGNATSRDSASLPGTWQAPVMEQTCCPGRYVLGTQPCKFYKPVHQRYYISRHPRSTLNIIVLRESETLWKRRKRGTFWSPGEFPFSAKSCKEEKPAASMLLLVDTTERTAGIACLPDPQSPGPERFPTRENLLSALLQGLLTHRGASLQPECPESLQLRAPECPGATALDKCKNPSVNTAFKRHIKHLYTISCFFFFFLRRSLALVTQAGVWWRDLASLQPPPPGFKRFSCLSLLSSWDYRLCHHAWIIFVFLVEPGFHHVSQAGLELLTLGSACLCLPECWDYRCEPPRPAEVFFSHNSLFFIFIFVETGSHSIAEAGVQLHNRNSLQPQTPGSSDLSASACWVTGTTGLQHHTQLILGALLLLFICLFFKNNFNLFEIHRVHVQVCHLGILPDAEVGGMIDHITQVLHIVPNSFSARPALCVCVCVCVCVCVCVCFELEPHPVSQAGVQWRNLSSLQTLPPGLKRFPSLASRVAGITDVYHHTWRCHLYVREYPCLAPTYEMKTCSIWFAVPALVCLEIMAFNCIHVAAKDMISFLFMAAKFFNIFVSMRSHCVAQTGLKLWPQAFLAPQPHKVLRLYLGATAPSPLMQFSMTPVFFFFFLFCFPFRDRVSLCCLGWSAVELIIAHYSLQFLSSSDPPASAFGVPRSINMSHYTQLMFLVGVFFFSLRDRVGRARWLAHTCNPSTLEAEAGGSQCQGIEAILANMVNPISVKTTKISWAWWRAPVVPAAQEAEAGESLDPGSVGCSELRSCHCTPAWATERDSVSKKKKRCGLAMLPRLVSNSKAQVIFLPWFPKCWDYSCEPLHLTFFFFPPPFFFETGSRSVTQAEVQWHLRSVSPWPPQAQAILPPQPPEQLGLQACATIPGRFFKFVVEMGSHYVAQAGLELLGPSDPPASVLRLQWSATMSSQLFNNEAVLTGVSSDWYLTVVLICISDDYVMSGIFSWVFCLFVLRQSLVLLPRLECSSVISARCSLRLPGSSHCPASASYVAGIAGGCHHTQLIFLVLVETGFLHVGQAGLELLTSSDPPTSASQSAGIIGVSHRARPSWVVLFCFETESHPVTQAAVQSHDLHLLLTSTSWVQVMLLPQPPEWLGLQACTHAWLIFIFLVEMGFHHVGQAGLELLTSGDPPASVSQSAGITDVYTQDTKISSGWVIGLMVKGKTMKQAGHDVIIAIILTLWRPKLEDTVAQKCETSPHSIVKPRLYKKTILKKKELAGHGEWSTPVIPASGEAEMGGSHESGARGHSEPGLYHSSLNDRAIPCLKKIKTVKQLKVESLQGLGVRKDSFRQDAGPWGRTQKNTGIKIGKLINEIYLNKTLVLITGHCLKHEKAPMGDAVLAVHTHNMTSICNLKITLPVVNQTESRRRSWAEGETFHKRKCRSGMVARACNPSTLGGRGGGSFEVRSSRQPGQHGENPSLLKIKEISQVWWHVPVVLAAWEAEVGESLEPGRQRLQRAEIAPLHSSLGNNKKKEMQEQSLSLVIREMQIKTEKPLHIHQCGSNEKNATMSSVSEDVKQLGLSYLASGRQNRATLARTVSQGLRKFSTQFITLWAGRFFLGRFFVVVVCLFVCFEISAYCNLGSLQPPPPGFTPFSFLSLPSGWDYRCAPPPPGTVGGQLPGLHEYGAVGGSTHTATAAMWACQHCTFMNQPGTGHCEMCSLPRT

SEQ ID NO: 1027975 - protein, 2289 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPAPSCILAGAIGNATSRDSASLPGTWQAPVMEQTCCPGRYVLGTQPCKFYKPVHQRYYISRHPRSTLNIIVLRESETLWKRRKRGTFWSPGEFPFSAKSCKEEKPAASMLLLVDTTERTAGIACLPDPQSPGPERFPTRENLLSALLQGLLTHRGASLQPECPESLQLRAPECPGATALDKCKNPSVNTAFKRHIKHLYTISCFFFFFLRRSLALVTQAGVWWRDLASLQPPPPGFKRFSCLSLLSSWDYRLCHHAWIIFVFLVEPGFHHVSQAGLELLTLGSACLCLPECWDYRCEPPRPAEVFFSHNSLFFIFIFVETGSHSIAEAGVQLHNRNSLQPQTPGSSDLSASACWVTGTTGLQHHTQLILGALLLLFICLFFKNNFNLFEIHRVHVQVCHLGILPDAEVGGMIDHITQVLHIVPNSFSARPALCVCVCVCVCVCVCVCFELEPHPVSQAGVQWRNLSSLQTLPPGLKRFPSLASRVAGITDVYHHTWRCHLYVREYPCLAPTYEMKTCSIWFAVPALVCLEIMAFNCIHVAAKDMISFLFMAAKFFNIFVSMRSHCVAQTGLKLWPQAFLAPQPHKVLRLYLGATAPSPLMQFSMTPVFFFFFLFCFPFRDRVSLCCLGWSAVELIIAHYSLQFLSSSDPPASAFGVPRSINMSHYTQLMFLVGVFFFSLRDRVGRARWLAHTCNPSTLEAEAGGSQCQGIEAILANMVNPISVKTTKISWAWWRAPVVPAAQEAEAGESLDPGSVGCSELRSCHCTPAWATERDSVSKKKKRCGLAMLPRLVSNSKAQVIFLPWFPKCWDYSCEPLHLTFFFFPPPFFFETGSRSVTQAEVQWHLRSVSPWPPQAQAILPPQPPEQLGLQACATIPGRFFKFVVEMGSHYVAQAGLELLGPSDPPASVLRLQWSATMSSQLFNNEAVLTGVSSDWYLTVVLICISDDYVMSGIFSWVFCLFVLRQSLVLLPRLECSSVISARCSLRLPGSSHCPASASYVAGIAGGCHHTQLIFLVLVETGFLHVGQAGLELLTSSDPPTSASQSAGIIGVSHRARPSWVVLFCFETESHPVTQAAVQSHDLHLLLTSTSWVQVMLLPQPPEWLGLQACTHAWLIFIFLVEMGFHHVGQAGLELLTSGDPPASVSQSAGITDVYTQDTKISSGWVIGLMVKGKTMKQAGHDVIIAIILTLWRPKLEDTVAQKCETSPHSIVKPRLYKKTILKKKELAGHGEWSTPVIPASGEAEMGGSHESGARGHSEPGLYHSSLNDRAIPCLKKIKTVKQLKVESLQGLGVRKDSFRQDAGPWGRTQKNTGIKIGKLINEIYLNKTLVLITGHCLKHEKAPMGDAVLAVHTHNMTSICNLKITLPVVNQTESRRRSWAEGETFHKRKCRSGMVARACNPSTLGGRGGGSFEVRSSRQPGQHGENPSLLKIKEISQVWWHVPVVLAAWEAEVGESLEPGRQRLQRAEIAPLHSSLGDRARLYLRKKKKKKKKKNKSGLFYKKDPLQQKGTSKHRLPVTPCGAGGIFLRALSTSKCACGGSAVWAGPALGGMLGAGSSQLPAPAPMPTLWQSLVGQKDECSFLFHPAGTVGGQLPGLHEYGAVGGSTHTATAAMWACQHCTFMNQPGTGHCEMCSLPRT

SEQ ID NO: 1027976 - protein, 673 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCTSRVAGITDVYHHTWRCHLYAQLAGSSQVSMSTAPSGAPHTRPLQPCGPVSTARS

SEQ ID NO: 1027977 - protein, 2289 aa, Homo sapiens; identical to SEQ ID NO: 1027975

SEQ ID NO: 1027978 - protein, 2033 aa, Homo sapiens
MFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPAPSCILAGAIGNATSRDSASLPGTWQAPVMEQTCCPGRTSYVHSPVNFINLYIRDTNLQASRSTLNIIVLRESETLWKRRKRGTFWSPGEFPFSAKSCKEEKPAASMLLLVDTTERTAGIACLPDPQSPGPERFPTRENLLSALLQGLLTHRGASCSPSALSPAAESTRVPGSYGPGQMLDPSVNTAFKRHIKHLYTISCFFFFFLRRSLALVTQAGVWWRDLASLQPPPPGFKRFSCLSLLSSWDYRLCHHAWIIFVFLVEPGFHHVSQAGLELLTLGSACLCLPECWDYRCEPPRPAEVFFSHNSLFFIFIFVETGSHSIAEAGVQLHNRNSLQPQTPGSSDLSASACWVTGTTGLQHHTQLILGALLLLFICLFFKNNFNLFEIHRVHVQVCHLGILPDAEVGGMIDHITQVLHIVPNSFSARPALCVCVCVCVCVCVCVCFELEPHPVSQAGVQWRNLSSLQTLPPGLKRFPSLASRVAGITDVYHHTWRCHLYVREYPCLAPTYEMKTCSIWFAVPALVCLEIMAFNCIHVAAKDMISFLFMAAKFFNIFVSMRSHCVAQTGLKLWPQAFLAPQPHKVLRLYLGATAPSPLMQFSMTPVFFFFFLFCFPFRDRVSLCCLGWSAVELIIAHYSLQFLSSSDPPASAFGVPRSINMSHYTQLMFLVGVFFFSLRDRVGRARWLAHTCNPSTLEAEAGGSQCQGIEAILANMVNPISVKTTKISWAWWRAPVVPAAQEAEAGESLDPGSVGCSELRSCHCTPAWATERDSVSKKKKRCGLAMLPRLVSNSKAQVIFLPWFPKCWDYSCEPLHLTFFFFPPPFFFETGSRSVTQAEVQWHLRSVSPWPPQAQTILPPQPPEQLGLQACATIPGRFFKFVVEMGSHYVAQAGLELLGPSDPPASVLRLQWSATMSSQLFNNEAVLTGVSSDWYLTVVLICISDDYVMSGIFSWVFCLFVLRQSLVLLPRLECSSVISARCSLRLPGSSHCPASASYVAGIAGGCHHTQLIFLVLVETGFLHVGQAGLELLTSSDPPTSASQSAGIIGVSHRARPSWVVLFCFETESHPVTQAAVQSHDLHLLLTSTSWVQVMLLPQPPEWLGLQACTHAWLIFIFLVEMGFHHVGQAGLELLTSGDPPASVSQSAGITDVYTQDTKISSGWVIGLMVKGKTMKQAGHDVIIAIILTLWRPKLEDTVAQKCETSPHSIVKPRLYKKTILKKKELAGHGEWSTPVIPASGEAEMGGSHESGARGHSEPGLYHSSLNDRAIPCLKKIKTVKQLLIESLQGLGVRKDSFRQDAGPWGRTQKNTGIKIGKLINEIYLNKTLVLITGHCYKHEKAPMGDAVLAVHTHNMTSICNLKITLPVVNQTESRRRSWAEGETFHKRKCRSGMVARACNPSTLGGRGGGSFEVRSSRQPGQHGENPSLLKIKEISQVWWHVPVVLAAWEAEVGESLEPGRQRLQRAEIAPLHSSLGNNKKKEMQEQSLSLVIREMQIKTEKPLHIHQCGSNEKNATMSSVSEDVKQLGLSYLASGRQNRATLARTVSQGLRKFSTQFITLWAGRFIPRRFFVVVVCLFVCFEISAYCNLGSLQPPPPGFTPFSFLSLPSGWDYRCAPPPPGTVGGQLPGLHEYGAVGGSTHTATAAMWACQHCTFMNQPGTGHCEMCSLPRT

SEQ ID NO: 1027979 - protein, 664 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCNSQGTCAGLSPGITDVYTQDTKISSGWVIGLMVKGKTMKQAGHDVS

SEQ ID NO: 1027980 - protein, 678 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSTVGGQLPGLHEYGAVGGSTHTATAAMWACQHCTFMNQPGTGHCEQWWPRAPSPPQGGTP

SEQ ID NO: 1027981 - protein, 497 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKSSSVFHFG

SEQ ID NO: 1027982 - protein, 2289 aa, Homo sapiens; identical to SEQ ID NO: 1027975

SEQ ID NO: 1027983 - protein, 2289 aa, Homo sapiens; identical to SEQ ID NO: 1027975

SEQ ID NO: 1027984 - protein, 496 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKNQNALMV

SEQ ID NO: 1027985 - protein, 461 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVAKHCFENQTNSCCGSGMFDGGLSKESTA

SEQ ID NO: 1027986 - protein, 284 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITQTRLMMIL

SEQ ID NO: 1027987 - protein, 132 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIK

SEQ ID NO: 1027988 - protein, 99 aa, Homo sapiens
MPFGRLFLKVSLLAGGPDNQVHFEGYQVSNQCMALVRDECLLPCKDAPELGYAKESSSEQYVPDVFYKVKSMVRKRTLYMEKWCDLSWTFLIWVYQRIL

SEQ ID NO: 1027989 - protein, 693 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVGVHWQSHSSLQALTSRAKRSSHVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSTVGGQLPGLHEYGAVGGSTHTATAAMWACQHCTFMNQPGTGHCEMCSLPRT

SEQ ID NO: 1027990 - protein, 2223 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPAPSCILAGAIGNATSRDSASLPGTWQAPVMEQTCCPGRYVLGTQPCKFYKPVHQRYYISRHPRSTLNIIVLRESETLWKRRKRGTFWSPGEFPFSAKSCKEEKPAASMLLLVDTTERTAGIACLPDPQSPGPERFPTRENLLSALLQGLLTHRGASLQPECPESLQLRAPECPGATALDKCKNPSVNTAFKRHIKHLYTISCFFFFFLRRSLALVTQAGVWWRDLASLQPPPPGFKRFSCLSLLSSWDYRLCHHAWIIFVFLVEPGFHHVSQAGLELLTLGSACLCLPECWDYRCEPPRPAEVFFSHNSLFFIFIFVETGSHSIAEAGVQLHNRNSLQPQTPGSSDLSASACWVTGTTGLQHHTQLILGALLLLFICLFFKNNFNLFEIHRVHVQVCHLGILPDAEVGGMIDHITQVLHIVPNSFSARPALCVCVCVCVCVCVCVCFELEPHPVSQAGVQWRNLSSLQTLPPGLKRFPSLASRVAGITDVYHHTWRCHLYVREYPCLAPTYEMKTCSIWFAVPALVCLEIMAFNCIHVAAKDMISFLFMAAKFFNIFVSMRSHCVAQTGLKLWPQAFLAPQPHKVLRLYLGATAPSPLMQFSMTPVFFFFFLFCFPFRDRVSLCCLGWSAVELIIAHYSLQFLSSSDPPASAFGVPRSINMSHYTQLMFLVGVFFFSLRDRVGRARWLAHTCNPSTLEAEAGGSQCQGIEAILANMVNPISVKTTKISWAWWRAPVVPAAQEAEAGESLDPGSVGCSELRSCHCTPAWATERDSVSKKKKRCGLAMLPRLVSNSKAQVIFLPWFPKCWDYSCEPLHLTFFFFPPPFFFETGSRSVTQAEVQWHLRSVSPWPPQAQAILPPQPPEQLGLQACATIPGRFFKFVVEMGSHYVAQAGLELLGPSDPPASVLRLQWSATMSSQLFNNEAVLTGVSSDWYLTVVLICISDDYVMSGIFSWVFCLFVLRQSLVLLPRLECSSVISARCSLRLPGSSHCPASASYVAGIAGGCHHTQLIFLVLVETGFLHVGQAGLELLTSSDPPTSASQSAGIIGVSHRARPSWVVLFCFETESHPVTQAAVQSHDLHLLLTSTSWVQVMLLPQPPEWLGLQACTHAWLIFIFLVEMGFHHVGQAGLELLTSGDPPASVSQSAGITDVYTQDTKISSGWVIGLMVKGKTMKQAGHDVIIAIILTLWRPKLEDTVAQKCETSPHSIVKPRLYKKTILKKKELAGHGEWSTPVIPASGEAEMGGSHESGARGHSEPGLYHSSLNDRAIPCLKKIKTVKQLKVESLQGLGVRKDSFRQDAGPWGRTQKNTGIKIGKLINEIYLNKTLVLITGHCLKHEKAPMGDAVLAVHTHNMVKPKFYQRIDKISQVWWHVPVVLAAWEAEVGESLEPGRQRLQRAEIAPLHSSLGDRARLYLRKKKKKKKKKNKSGLFYKKDPLQQKGTSKQQAPCYSLWCRRHFSEGIKHFKVCLWWECCVGRTSTGWDVGGGELSAACPCPHAHTLAVSGGPEDDECSFLFHPAGTVGGQLPGLHEYGAVGGSTHTATAAMWACQHCTFMNQPGTGHCEMCSLPRT

SEQ ID NO: 1027991 - protein, 2289 aa, Homo sapiens; identical to SEQ ID NO: 1027975

SEQ ID NO: 1027992 - protein, 1829 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPAPSCILAGAIGNATSRDSASLPGTWQAPVMEQTCCPGRYVLGTQPCKFYKPVHQRYYISRHPRSTLNIIVLRESETLWKRRKRGTFWSPGEFPFSAKSCKEEKPAASMLLLVDTTERTAGIACLPDPQSPGPERFPTRENLLSALLQGLLTHRGASLQPECPESLQLRAPECPGATALDKCKNPSVNTAFKRHIKHLYTISCFFFFFLRRSLALVTQAGVWWRDLASLQPPPPGFKRFSCLSLLSSWDYRLCHHAWIIFVFLVEPGFHHVSQAGLELLTLGSACLCLPECWDYRCEPPRPAEVFFSHNSLFFIFIFVETGSHSIAEAGVQLHNRNSLQPQTPGSSDLSASACWVTGTTGLQHHTQLILGALLLLFICLFFKNNFNLFEIHRVHVQVCHLGILPDAEVGGMIDHITQVLHIVPNSFSARPALCVCVCVCVCVCVCVCFELEPHPVSQAGVQWRNLSSLQTLPPGLKRFPSLASRVAGITDVYHHTWRCHLYVREYPCLAPTYEMKTCSIWFAVPALVCLEIMAFNCIHVAAKDMISFLFMAAKFFNIFVSMRSHCVAQTGLKLWPQAFLAPQPHKVLRLYLGATAPSPLMQFSMTPVFFFFFLFCFPFRDRVSLCCLGWSAVELIIAHYSLQFLSSSDPPASAFGVPRSINMSHYTQLMFLVGVFFFSLKIGLAGPGGGITDVYTQDTKISSGWVIGLMVKGKTMKQAGHDVIIAIILTLWRPKLEDTVAQKCETSPHSIVKPRLYKKTILKKKELAGHGEWSTPVIPASGEAEMGGSHESGARGHSEPGLYHSSLNDRAIPCLKKIKTVKQLKVESLQGLGVRKDSFRQDAGPWGRTQKNTGIKIGKLINEIYLNKTLVLITGHCLKHEKAPMGDAVLAVHTHNMTSICNLKITLPVVNQTESRRRSWAEGETFHKRKCRSGMVARACNPSTLGGRGGGSFEVRSSRQPGQHGENPSLLKIKEISQVWWHVPVVLAAWEAEVGESLEPGRQRLQRAEIAPLHSSLGDRARLYLRKKKKKKKKKNKSGLFYKKDPLQQKGTSKHRLPVTPCGAGGIFLRALSTSKCACGGSAVWAGPALGGMLGAGSSQLPAPAPMPTLWQSLVGQKDECSFLFHPAGTVGGQLPGLHEYGAVGGSTHTATAAMWACQHCTFMNQPGTGHCEMCSLPRT

SEQ ID NO: 1027993 - protein, 2289 aa, Homo sapiens; identical to SEQ ID NO: 1027975

SEQ ID NO: 1027994 - protein, 2289 aa, Homo sapiens; identical to SEQ ID NO: 1027975

SEQ ID NO: 1027995 - protein, 113 aa, Homo sapiens
GRVGPDAWAQHVPPWRAGATAGILQAECSLQTGNAERLLTPNPVDKSPAVLERPLASTWHLELGRTGRGGCCHHPAFSLFSVLFVWPPCPHVFLAGSSWLPPCLTAWWQAPCL

SEQ ID NO: 1027996 - protein, 691 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPAPSCILAGAIGNATSRDSASLPGTWQAPVMEQTCCPGRTS

SEQ ID NO: 1027997 - protein, 435 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVLRHPAAKQGAWPGSVGHPGQGELGEWPGCVGYWLSPAAQGQVQALYVLKLHICLLGTNNLYVPLT

SEQ ID NO: 1027998 - protein, 113 aa, Homo sapiens; identical to SEQ ID NO: 1027995

SEQ ID NO: 1027999 - protein, 191 aa, Homo sapiens
ADCARHRDVGGWRSRAGLKLERRWRRRREAGAGAEAAAGSARPLGRQAAAARGSSPEAGAAAMAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQL

SEQ ID NO: 1028000 - protein, 277 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQYTSPDFLYIRSWLPCIFFSGGVTVGNIGRQLAMGVPEKPHSD

SEQ ID NO: 1028001 - protein, 277 aa, Homo sapiens; identical to SEQ ID NO: 1028000

SEQ ID NO: 1028002 - protein, 277 aa, Homo sapiens; identical to SEQ ID NO: 1028000

SEQ ID NO: 1028003 - protein, 269 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQYTSPDFLYIRSWLPCIFFSGGVTVGNIGRQLAMG

SEQ ID NO: 1028004 - protein, 277 aa, Homo sapiens; identical to SEQ ID NO: 1028000

SEQ ID NO: 1028005 - protein, 235 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQ

SEQ ID NO: 1028006 - protein, 277 aa, Homo sapiens; identical to SEQ ID NO: 1028000

SEQ ID NO: 1028007 - protein, 277 aa, Homo sapiens; identical to SEQ ID NO: 1028000

SEQ ID NO: 1028008 - protein, 277 aa, Homo sapiens; identical to SEQ ID NO: 1028000

SEQ ID NO: 1028009 - protein, 277 aa, Homo sapiens; identical to SEQ ID NO: 1028000

SEQ ID NO: 1028010 - protein, 235 aa, Homo sapiens; identical to SEQ ID NO: 1028005

SEQ ID NO: 1028011 - protein, 109 aa, Homo sapiens [sequence omitted]

SEQ ID NO: 1028012 - protein, 235 aa, Homo sapiens; identical to SEQ ID NO: 1028005

SEQ ID NO: 1028013 - protein, 147 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAGEYPSWFFWK

SEQ ID NO: 1028014 - protein, 277 aa, Homo sapiens; identical to SEQ ID NO: 1028000

SEQ ID NO: 1028015 - protein, 277 aa, Homo sapiens; identical to SEQ ID NO: 1028000

SEQ ID NO: 1028016 - protein, 287 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAAVVGLLYPCIDSHLGEPHKFKREWASVMRCIAVFVGINHASAVSLIFCATSRKLDFANNVQLSLTLAALSLGLWWTFDRSRSGLGLGITIAFLATLITQFLVYNGVYQYTSPDFLYIRSWLPCIFFSGGVTVGNIGRQLAMGVPEKPHSD

SEQ ID NO: 1028017 - protein, 164 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAGIHPQISSIFVLGSLVYFSQEASRWGT

SEQ ID NO: 1028018 - protein, 164 aa, Homo sapiens; identical to SEQ ID NO: 1028017

SEQ ID NO: 1028019 - protein, 277 aa, Homo sapiens; identical to SEQ ID NO: 1028000

SEQ ID NO: 1028020 - protein, 277 aa, Homo sapiens; identical to SEQ ID NO: 1028000

SEQ ID NO: 1028021 - protein, 277 aa, Homo sapiens; identical to SEQ ID NO: 1028000

SEQ ID NO: 1028022 - protein, 277 aa, Homo sapiens; identical to SEQ ID NO: 1028000

SEQ ID NO: 1028023 - protein, 277 aa, Homo sapiens; identical to SEQ ID NO: 1028000

SEQ ID NO: 1028024 - protein, 78 aa, Homo sapiens
EEGSSWRLLAMHHNSPGGSVFECAGLSESVTFLYSLPSEPSGLSCAQSGSFAHGHDLVTSHGGCLEILLHGVVFFSKC

SEQ ID NO: 1028025 - protein, 84 aa, Homo sapiens
PAFVVWRFFSWFGGFSRLPRGGRAAASFVGLVCCFGSLGFFFCGGIFFFAGVFFVFFFWGVLLSLSCAEGQRMAYGGPGWMGKG

SEQ ID NO: 1028026 - protein, 80 aa, Homo sapiens
SPFLLVGLMAVNNCGLQAGSPTPQCSNPGFTCWKYLSVQGQLFRGSSLLFRRVSSGSCFALEKPESSKKHGLNLATVGEA

SEQ ID NO: 1028027 - protein, 156 aa, Homo sapiens
MGGGACVCSHCSKVFPVATSVPLSPPWSPLCAPGLPAFGAHRILPAPLARAREGGWGHSKEAGLKPSPGLLPNILLPESPSKRFNHGQLPVPQTVFGGGGPGSPLLVPPSPLFLFFHLCLFLPQPRHTEAHLLPLRRRDSQHPCCLSVTHTLIYGV

SEQ ID NO: 1028028 - protein, 397 aa, Homo sapiens
IVPERLCESKEGGQGEETCSQIPDGILYKKSPGVKPCESSVCGEVGMGPSSLNRHIRDHTGREPNEYQEYGKKSYTRNQCGRALSYHRSFPVRERTHPGGKPYDCKECGETFISLVSIRRHMLTHRGGVPYKCKVCGKAFDYPSLFRIHERSHTGEKPYECKQCGKAFSCSSYIRIHERTHTGDKPYECKQCGKAFSCSKYIRIHERTHTGEKPYECKQCGKAFRCASSVRSHERTHTGEKLFECKECGKALTCLASVRRHMIKHTGNGPYKCKVCGKAFDFPSSFRIHERTHTGEKPYDCKQCGKAFSCSSSFRKHERIHTGEKPYKCTKCGKAFSRSSYFRIHERTHTGEKPYECKQCGKAFSRSTYFRVHEKIHTGEKPYENPNPNASVVPVLS

SEQ ID NO: 1028029 - protein, 397 aa, Homo sapiens; identical to SEQ ID NO: 1028028

SEQ ID NO: 1028030 - protein, 145 aa, Homo sapiens
MTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 1028031 - protein, 189 aa, Homo sapiens
SNHASGSGESVGGVPTWLEGCGSGNPSPRSGGGPGARLTLPALQMTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 1028032 - protein, 243 aa, Homo sapiens
KLTARYEAGVCVGGVPTWLEGCGSGNPSPRSGGGPGARLTLPALQMTVHNLYLFDRNGVCLHYSEWHRKKQAGIPKEEGDERAPVQPGRPLISKHLQSQPSPSSPKPSSFPSPQPISRIKPRANSGPFSLQEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 1028033 - protein, 189 aa, Homo sapiens; identical to SEQ ID NO: 1028031

SEQ ID NO: 1028034 - protein, 190 aa, Homo sapiens
NLRLGTRLGVCVGGVPTWLEGCGSGNPSPRSGGGPGARLTLPALQMTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 1028035 - protein, 182 aa, Homo sapiens
NLRLGTRLGVCVGGVPTWLEGCGSGNPSPRSGGGPGARLTLPALQMTVHNLYLFDRNGVCLHYSEWHRKKEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 1028036 - protein, 110 aa, Homo sapiens
MECVCTTANGTARSKQGFPRRRKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 1028037 - protein, 145 aa, Homo sapiens; identical to SEQ ID NO: 1028030

SEQ ID NO: 1028038 - protein, 189 aa, Homo sapiens; identical to SEQ ID NO: 1028031

SEQ ID NO: 1028039 - protein, 110 aa, Homo sapiens; identical to SEQ ID NO: 1028036

SEQ ID NO: 1028040 - protein, 127 aa, Homo sapiens
LNNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 1028041 - protein, 118 aa, Homo sapiens
MAAIFYQQVEGGVIRAHELHMDPCMKRSGAQSRRAISISQREGRRHHTKCHAGPPRKPALRSLISSTSTEFFSYTLSGNKVEVAVKQIIARKAMEQRGAFSNPEALHLYWDIPELNGF

SEQ ID NO: 1028042 - protein, 92 aa, Homo sapiens
MPAADPHTPAQTKANDSHSATSRKPAAGRKNTNNTDEARRERDKGGREERAKSDEQEDKTIRGDRGGRQKTAGRDREDQNHVDKKERQQAEH

SEQ ID NO: 1028043 - protein, 92 aa, Homo sapiens; identical to SEQ ID NO: 1028042

SEQ ID NO: 1028044 - protein, 313 aa, Homo sapiens
MFCYVLPASCLNSLCGGKAGVGLGNAAFSRRGTRLSFCNAGEGLDASVTSHKAWLPDSPAGSDAFLPWALGLKQPGFLLVSGWCLSSCNLSSATYTPPWPTLSLKSFLRKKNNKPKKTNPTPAPTHNAHRQDTQRQQQSSARRRGGARHPHNAARVRGGTATACARGAARRREQAGPQRARRRNAKKRRRGRANAAPQPRRRRRDHTQLGGIERREKRPQARQRQTRTHPPRQKQTTATAPQAASPRQGGRTQITRTKRGASATREGEKNAPKATNRRTRRSGETEAGGRRQRDGTEKIQNHVDKKERQQAEH

SEQ ID NO: 1028045 - protein, 111 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDPNKTDPWSLGSHQS

SEQ ID NO: 1028046 - protein, 191 aa, Homo sapiens
MPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLARGIDVQQVSLVINYDLPTNRENYIHRIGRGGRFGRKGVAINMVTEEDKRTLRDIETFYNTSIEEMPLNVADLI

SEQ ID NO: 1028047 - protein, 191 aa, Homo sapiens; identical to SEQ ID NO: 1028046

SEQ ID NO: 1028048 - protein, 132 aa, Homo sapiens
MPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLGKLYPQNRSRWTVWP

SEQ ID NO: 1028049 - protein, 191 aa, Homo sapiens; identical to SEQ ID NO: 1028046

SEQ ID NO: 1028050 - protein, 376 aa, Homo sapiens
GSEAPPVAGTSGELEQPSSQVMVSVINTVDTSHEDMIHDAQMDYYGTRLATCSSDRSVKIFDVRNGGQILIADLRGHEGPVCASGLGLHPMYGQHPGNRCSYDRKVIIWREENGTWEKSHEHAGHDSSVNSVCWAPHDYGLILACGSSDGAISLLTYTGEGQWEVKKINNAHNHWLQCRQLGPCCCTWKPHRPPIGAETQLHQESVLQYMVLLVEQRSIPSMIGSEGAKERLEWQGMEQQARSAQVTGLRDVAWAPAIGLPIQHRSLMLLPGWSVCSFWDAVNDWLKRYVCPPKWWVTVFNDVVLACELVLSHANILGCLWWMTTKVTLWKGSQLMAQRVCISDVNKGQGSVSASVTGGAEKKQLTRPVGLVPTGS

SEQ ID NO: 1028051 - protein, 406 aa, Homo sapiens
VLRRPSRVKARSRLGFSALPNPKLEPFSSLHRLEIWGALAVPCGPFRGESKVSVINTVDTSHEDMIHDAQMDYYGTRLATCSSDRSVKIFDVRNGGQILIADLRGHEGPVCASGLGLHPMYGQHPGNRCSYDRKVIIWREENGTWEKSHEHAGHDSSVNSVCWAPHDYGLILACGSSDGAISLLTYTGVRPMGSKEDQQRSQPLAANAVSWAPAVVPGSLIDHPSGQKPNYIKRFAISGCDKLIKLWKEEEARPVDRMAATTSIEISHQLIVGDSRNSAPLGPYLIGLDPNMNAIDELLPGWSVCSFGALRMIGSSNTLCPPKWWVTVFNGCGCWHVSLVLSHANILGCLWWMTTKVTLWKGSQLMGQRVCISDVNKGQGSESASVTEGAEKEQLTRPVGLVPTGS

SEQ ID NO: 1028052 - protein, 456 aa, Homo sapiens
NADFSTWGTSGSQGLSTQSSAYSSSYGYPPSSLGRAITDGQAGFGNDTLSKVPGISSIEQGMTGLKIGGDLTAAVTKTVGTALSSSGMTSIATNSVPPVSSAAPKPTSWAAIARKPAKPQPKLKPKGNVGIGGSAVPPPPIKHNMNIGTWDEKGSVVKAPPTQPVLPPQTIIQQPQPLIQPPPLVQSQLPQQQPQPPQPQQQQGPQPQAQPHQVQPQQQQLQNRWVAPRNRGAGFNQNNGAGSENFGLGVVPVSASPSSVEVHPVLEKLKAINNYNPKDFDWNLKNGRVFIIKSYSEDDIHRSIKYSIWCSTEHGNKRLDAAYRSLNGKGPLYLLFSVNGSGHFCGVAEMKSVVDYNAYAGVWSQDKWKGKFEVKWIFVKDVPNNQLRHIRLENNDNKPVTNSRDTQEVPLEKAKQVLKIIATFKHTTSIFDDFAHYEKRQEEEEAMRRERNRNKQ

SEQ ID NO: 1028053 - protein, 456 aa, Homo sapiens; identical to SEQ ID NO: 1028052

SEQ ID NO: 1028054 - protein, 97 aa, Homo sapiens
NGIKGNHGPMESNGDTIEYELNGIINGIEWNHRKCNQVESSNGIQGNHRMELNGIFEWIRLESSSNGLELNYRMDLNGIIIEWNPMESSNGIEWNHH

SEQ ID NO: 1028055 - protein, 41 aa, Homo sapiens
MDHPPYSSPRERGEPPRGVLLRGRIQSFLHLGVRGGDALET

SEQ ID NO: 1028056 - protein, 579 aa, Homo sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMSYVISGDGNGKLNIWDWKTTKLYSRFKAHDKVCIGAVWHPHETSKVITCGWDGLIKLWD

SEQ ID NO: 1028057 - protein, 579 aa, Homo sapiens; identical to SEQ ID NO: 1028056

SEQ ID NO: 1028058 - protein, 579 aa, Homo sapiens; identical to SEQ ID NO: 1028056

SEQ ID NO: 1028059 - protein, 288 aa, Homo sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTKKKKKKKKNGGFFGGGGKRGFEGAVVGFRAPFLAKGENREGPPRGGGIISKSQGTVDLRRQTTKHGKKERTTHSAQNRVDKHTTHTPSAKRTATKTLTQPTQTTPQDKKESAP

SEQ ID NO: 1028060 - protein, 579 aa, Homo sapiens; identical to SEQ ID NO: 1028056

SEQ ID NO: 1028061 - protein, 579 aa, Homo sapiens; identical to SEQ ID NO: 1028056

SEQ ID NO: 1028062 - protein, 579 aa, Homo sapiens; identical to SEQ ID NO: 1028056

SEQ ID NO: 1028063 - protein, 579 aa, Homo sapiens; identical to SEQ ID NO: 1028056

SEQ ID NO: 1028064 - protein, 470 aa, Homo sapiens
MLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMSYVISGDGNGKLNIWDWKTTKLYSRFKAHDKVCIGAVWHPHETSKVITCGWDGLIKLWD

SEQ ID NO: 1028065 - protein, 447 aa, Homo sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEW

SEQ ID NO: 1028066 - protein, 69 aa, Homo sapiens
MVPPVQVSPLIKLGRYSALFLGVAYGATRYNYLKPRAEEERRIAAEEKKKQDELKRIARELAEDDSILK

SEQ ID NO: 1028067 - protein, 69 aa, Homo sapiens; identical to SEQ ID NO: 1028066

SEQ ID NO: 1028068 - protein, 37 aa, Homo sapiens
MCNLKLICTTGYLTGATDTESVLFLLKYSMELTLNLN

SEQ ID NO: 1028069 - protein, 69 aa, Homo sapiens; identical to SEQ ID NO: 1028066

SEQ ID NO: 1028070 - protein, 69 aa, Homo sapiens; identical to SEQ ID NO: 1028066

SEQ ID NO: 1028071 - protein, 81 aa, Homo sapiens
SSAFASKALLACAASCSVCRLCFRCGGQGQDGATGAGLSAHQDYLKPRAEEERRIAAEEKKKQDELKRIARELAEDDSILK

SEQ ID NO: 1028072 - protein, 85 aa, Homo sapiens
APPLPPRLCWLVRHPAPSAGCASGAEVRDKMVPPVQVSPLIKLGRYSALFLGVAYGATRYNYLKPRAEEERRIAAEEKKKISDCV

SEQ ID NO: 1028073 - protein, 69 aa, Homo sapiens; identical to SEQ ID NO: 1028066

SEQ ID NO: 1028074 - protein, 69 aa, Homo sapiens; identical to SEQ ID NO: 1028066

SEQ ID NO: 1028075 - protein, 323 aa, Homo sapiens
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRDVPFSVVYFPLFANLNQLGRPASEEKSPFYVSFLAGCVAGSAAAVAVNPCDVVKTRLQSLQRGVNEDTYSGILDCARKILRHEGPSAFLKGAYCRALVIAPLFGIAQVVYFLGIAESLLGLLQDPQA

SEQ ID NO: 1028076 - protein, 348 aa, Homo sapiens
MADKQISLPAKLINGGIAGLIGVTCVFPIDLAKTRLQNQQNGQRVYTSIPRQSRDPGLRLAPAGPGSPCPLGHRSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRDVPFSVVYFPLFANLNQLGRPASEEKSPFYVSFLAGCVAGSAAAVAVNPCDVVKTRLQSLQRGVNEDTYSGILDCARKILRHEGPSAFLKGAYCRALVIAPLFGIAQVVYFLGIAESLLGLLQDPQA

SEQ ID NO: 1028077 - protein, 323 aa, Homo sapiens; identical to SEQ ID NO: 1028075

SEQ ID NO: 1028078 - protein, 323 aa, Homo sapiens; identical to SEQ ID NO: 1028075

SEQ ID NO: 1028079 - protein, 323 aa, Homo sapiens; identical to SEQ ID NO: 1028075

SEQ ID NO: 1028080 - protein, 323 aa, Homo sapiens; identical to SEQ ID NO: 1028075

SEQ ID NO: 1028081 - protein, 323 aa, Homo sapiens; identical to SEQ ID NO: 1028075

SEQ ID NO: 1028082 - protein, 405 aa, Homo sapiens
MGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDDGISVSGFPLSSPFRQVVRPRVEGKPVNPPESNKAGDYSHVKTLEAVLNFKYSGGPGHTEGYYRNITT

SEQ ID NO: 1028083 - protein, 345 aa, Homo sapiens
MGNPALSVRHLSFLLQTMLDFLSDQEKKDVAQSLENYTSKCPGTMEPIALPGGLTLPPVPFTKLPIVRHVKLLNLPASLRPHKMKSLLGQNVSTKSPFIYSPIIAHNRGEERNKKIDFQWVQGDVCEVQLMVYNPMPFELRVENMGLLTSGVEFESLPAALSLPAESGLYPVTLVGVPQTTGTITVNGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDGKRFPNFN

SEQ ID NO: 1028084 - protein, 248 aa, Homo sapiens
YKDLHIYSLSFGPSQPCETGMQMLLSSPSRTRTVRVVGLRAGVWVSAGGPRAASELRSSEEEPRTLRTASAVGVRPKALPVERRSSFSIPGYHTTVFGVFSDCLLDNLPGIKTSGSTVEVIPALPRLQISTSLPRSAHSLQPSSGDEISTNVSVQLYNGESQQLIIKLENIGMEPLEKLEVTSKVLTTKEKLYGDFLSWKLEETLAQFPLQPGKVATFTINIKVKLDFSCQENLLQDLSDGKRFPNFN

SEQ ID NO: 1028085 - protein, 196 aa, Homo sapiens
MGISRDNWHKRRKTGGKRKPYHKKRKYELGRPAANTKIGPRRIHTVRVRGGNKKYRALRLDVGNFSWGSECCTRKTRIIDVVYNASNNELVRTKTLVKNCIVLIDSTPYRQWKGAKLTPEEEEILNKKRSKKIQKKYDERKKNAKISSLLEEQFQQGKLLACIASRPGQCGRADGYVLEGKELEFYLRKIKARKGK

SEQ ID NO: 1028086 - protein, 126 aa, Homo sapiens
GPPPPPCLVGSRMRVLPVPVSRPERDASVELSTMRCRLCAGQKGAKLTPEEEEILNKKRSKKIQKKYDERKKNAKISSLLEEQFQQGKLLACIASRPGQCGRADGYVLEGKELEFYLRKIKARKGK

SEQ ID NO: 1028087 - protein, 105 aa, Homo sapiens
HSPLLTKRRAMGISRDNWHKRRKTGGKRKPYHKKRKYELGRPAANTKIGPRRIHTVRVRGGNKKYRALRLDVGNFSCVRSGAVVLAIHSIGHPSSDMCYTLRSNL

SEQ ID NO: 1028088 - protein, 244 aa, Homo sapiens
MGISRDNWHKRRKTGGKRKPYHKKRKYELGRPAANTKIGPRRIHTVRVRGGNKKYRALRLDVGNFSWGSECCTRKTRIIDVVYNASNNELVRTKTLVKNCIVLIDSTPYRQWYESHYALPLGRKKGAKLTPEEEEILNKKRSKKIQKKYDERKKNAKISSLLEEQFQQGKLLACIASRPGQCGRADGYVLEGKELEFYLRKSAAAIICCLTMYKVLCLFQKKKKKKNCWGWPGKFKPPLGRGPC

SEQ ID NO: 1028089 - protein, 208 aa, Homo sapiens [sequence omitted]

SEQ ID NO: 1028090 - protein, 305 aa, Homo sapiens
MGISRDNWHKRRKTGGKRKPYHKKRKYELGRPAANTKIGPRRIHTVRVRGGNKKYRALRLDVGNFSCGTQSVSECPFGRWRGKTHPKSVFKIHPMWGLARWLTPISPARWEAEAGGSPECQEFEVLAWANQSETLMVRTRRFNVRIQASNSCGLYDPRHFEAFSVAMTRISRYLGSSFSRPGLSCFQSSSCCDDWCLWFAHVLACASGVTLGVPLPAILAPGVEGDSPWPRSLAMKCGINRPCAYLARSASCYSQVDDGGSHAWLGQGWSLPFLGLLADSTGFDLPMLLGYRCVSSVCRTARVSG

SEQ ID NO: 1028091 - protein, 85 aa, Homo sapiens
HSPLLTKRRAMGISRDNWHKRRKTGGKRKPYHKKRKYELGRPAANTKIGPRRIHTVRVRGGNKKYRALRLDVGNFSSRVAQCGDR

SEQ ID NO: 1028092 - protein, 224 aa, Homo sapiens
MGISRDNWHKRRKTGGKRKPYHKKRKYELGRPAANTKIGPRRIHTVRVRGGNKKYRALRLDVGNFSWGSECCTRKTRIIDVVYNASNNELVRTKTLVKNCIVLIDSTPYRQWYESHYALPLGRKKGAKLTPTMLLPLGRQKGAKLTPEEEEILNKKRSKKIQKKYDERKKNAKISSLLEEQFQQGKLLACIASRPGQCGRADGYVLEGKELEFYLRKIKARKGK

SEQ ID NO: 1028093 - protein, 288 aa, Homo sapiens
MDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 1028094 - protein, 288 aa, Homo sapiens; identical to SEQ ID NO: 1028093

SEQ ID NO: 1028095 - protein, 288 aa, Homo sapiens; identical to SEQ ID NO: 1028093

SEQ ID NO: 1028096 - protein, 435 aa, Homo sapiens
MAGAGGGGCPAGGNDFQWCFSQVKGAIDEDVAEADIISTVEFNYSGDLLATGDKGGRVVIFQREQENKSRPHSRGEYNVYSTFQSHEPEFDYLKSLEIEEKINKIRWLPQQNAAHFLLSTNDKTIKLWKISERDKRAEGYNLKDEDGRLRDPFRITALRVPILKPMDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 1028097 - protein, 251 aa, Homo sapiens
SGCPAKRRPEGVCGRSLGSPGVPERVGAAGGASLLEERRVHTGTRRAGERLGPRAEELACARRPRLPSAVAQASLPPYSRAAPGAGALGAPGSPRGAPVRCPSEEAEGDDVIERGDGHWAAILNKGKKDPSPAAAAAAAAPAVVAAPGLSARLQRRGGRLPGLPRSPPVPPPAAMAGAGGGGCPAGGNDFQWCFSQVKGAIDEDVAEGRGEESSGLLPQIMLSRQQLHLPLALLIRGNDNSVKTADDVQGL

SEQ ID NO: 1028098 - protein, 461 aa, Homo sapiens
MACGRHLPFFIKSYNWRSYRELGFLLSHTRAHLTPGHCPLKSDIISTVEFNYSGDLLATGDKGGRVVIFQREQENKSRPHSRGEYNVYSTFQSHEPEFDYLKSLEIEEKINKIRWLPQQNAAHFLLSTNDKTIKLWKISERDKRAEGYNLKDEDGRLRDPFRITALRVPILKPMDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 1028099 - protein, 453 aa, Homo sapiens
MAGAGGGGCPAGGNDFQWCFSQVKGAIDEDVAEADIISTVEFNYSGDLLATGDKGGRVVIFQREQENKSRPHSRGEYNVYSTFQSHEPEFDYLKSLEIEEKINKIRWLPQQNAAHFLLSTNDKTIKLWKISERDKRAEGYNLKDEDGRLRDPFRITALRVPILKPMDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 1028100 - protein, 491 aa, Homo sapiens
MAGAGGGGCPAGGNDFQWCFSQVKGAIDEDVAEADIISTVEFNYSGDLLATGDKGGRVVIFQREQEVLAQPRLSCPAMKCEQLSQHFLQRSLAGVWILSSLQGENKSRPHSRGEYNVYSTFQSHEPEFDYLKSLEIEEKINKIRWLPQQNAAHFLLSTNDKTIKLWKISERDKRAEGYNLKDEDGRLRDPFRITALRVPILKPMDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 1028101 - protein, 453 aa, Homo sapiens; identical to SEQ ID NO: 1028099

SEQ ID NO: 1028102 - protein, 453 aa, Homo sapiens; identical to SEQ ID NO: 1028099

SEQ ID NO: 1028103 - protein, 137 aa, Homo sapiens
MEELTEVITAAEFHPHQCNVFVYSSSKGTIRLCDMRSSALCDRHSKFFEEPEDPSSRSFFSEIISSISDVKFSHSGRYMMTRDLPVGEGVGPQHGRAGRWRPTRSTSTCAASSALSMRTTASLTSLSVAGTVRIAPS

SEQ ID NO: 1028104 - protein, 238 aa, Homo sapiens
AGVRPRRRPEGVCGRSLGSPGVPERVGAAGGASLLEERRGAHRHPTAGERLGPRAEELACARRPRLPSAVAQASLPPYSRAAPGAGALGAPGSPRGAPVRCPSEEAEGDDVIERGEGIGRHFEQGEKRSLPGGGGGGGGAGGGGGPGAERSAAAARRPSPWSAAVPARPAAGCHGRSRRRRLPRGRQRLPVVLLAGQGGHRRGRGRRLSSSSLKAGCPPSHPSPCRGPSTKVMIGNSC

SEQ ID NO: 1028105 - protein, 137 aa, Homo sapiens; identical to SEQ ID NO: 1028103

SEQ ID NO: 1028106 - protein, 219 aa, Homo sapiens
MAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYELLYRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKE

SEQ ID NO: 1028107 - protein, 118 aa, Homo sapiens
GAIDYCKSKASTFAFMESLTLGLLCPGVSATTVLPFHTSTEMFQGMRVRFPNLFPPLKPETVARRTVEAVQLNQALLLLPWTMHALVILKSILPQAALEEIHKFSGTYTCMNTFKGRT

SEQ ID NO: 1028108 - protein, 118 aa, Homo sapiens; identical to SEQ ID NO: 1028107

SEQ ID NO: 1028109 - protein, 67 aa, Homo sapiens
DFEPALFTRAYAFTHAAGKDRRDGLVDDHDLEGHAWRSAAVPVTTLNLATPARTIAVINFSNKRKFN

SEQ ID NO: 1028110 - protein, 118 aa, Homo sapiens; identical to SEQ ID NO: 1028107

SEQ ID NO: 1028111 - protein, 118 aa, Homo sapiens; identical to SEQ ID NO: 1028107

SEQ ID NO: 1028112 - protein, 126 aa, Homo sapiens
GRLLLLLLEFKLLTMYGDMLLLGEQDSSCPQRRIRLPLGQSQDLCTGLMGITDPHREAGKQPEATLTLLNISSSVEFIVNCFSSLTSLSSVHRPFPGGSVPRCSASRSKTHSSSACTNWLNGRNEK

SEQ ID NO: 1028113 - protein, 129 aa, Homo sapiens
MGILSFTTSYFSSPSSSSPFTSSTISSCISSSSSSSACCSPGILVSSRRFGTRGAPGLGAGRLGTQRGRGFRGRGGGGTAGTAGHWSEHIAPPPGAEPEGPRRPAQTARRGRRAQTWRPPQSPDSQAPG

SEQ ID NO: 1028114 - protein, 433 aa, Homo sapiens
MRERRRLLEGRKKTGEEADRGRGGRRGRRREKGERTERGGLEVHEGGERELQRGERTAEGERDSPEWNVEGKQSSGEPGAAMEGTGGELGGQGNWGPEDAPGLLARASLIMLPWPLPLASSALTLLFGALTSLFLWYCYRLGSQDMQALGAGSRAGGVRGGPVGCSEAGGPSPGGPGDPGEGPRTEGLVSRRLRAYARRYSWAGMGRVRRAAQGGPGPGRGPGVLGIQRPGLLFLPDLPSAPFVPRDAQRHDVELLESSFPAILRDFGAVSWDFSGTTPPPRGWSPPLAPGCYQLLLYQAGRCQPSNCRRCPGAYRALRGLRSFMSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFAPDP

SEQ ID NO: 1028115 - protein, 367 aa, Homo sapiens
MRERRRLLEGRKKTGEEADRGRGGRRGRRREKGERTERGGLEVHEGGERELQRGERTAEGERDSPEWNVEGKQSSGEPGAAMEGTGGELGGQGNWGPEDAPGLLARASLIMLPWPLPLASSALTLLFGALTSLFLWYCYRLGSQDMQALGAGSRAGGVRGGPVGCSEAGGPSPGGPGDPGEGPRTEGLVSRRLRAYARRYSWAGMGRVRRAAQGWPRPWERARGPRYSAPRPAFPTRPAFSPLCAAGRPAARRGAPGEQLPCHFAGLRGCELGLLRDYPSASGLVPTSGPRVLPAPAVPSRPVPTQQLPPVPGGLSGTEGASKLYECQHLRQCRLFRSPAWGPARGPLWAHQCPGQMPSGPKDPSWL

SEQ ID NO: 1028116 - protein, 367 aa, Homo sapiens; identical to SEQ ID NO: 1028115

SEQ ID NO: 1028117 - protein, 109 aa, Homo sapiens
MSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFAPDP

SEQ ID NO: 1028118 - protein, 446 aa, Homo sapiens
MRERRRLLEGRKKRVRRLTDRDRRTDTNDRYDGTTTQQGDDAHAPHTDGVARVALTPDGGERELQRGERTAEGERDSPEWNVEGKQSSGEPGAAMEGTGGELGGQGNWGPEDAPGLLARASLIMLPWPLPLASSALTLLFGALTSLFLWYCYRLGSQDMQALGAGSRAGGVRGGPVGCSEAGGPSPGGPGDPGEGPRTEGLVSRRLRAYARRYSWAGMGRVRRAAQGGPGPGRGPGVLGIQRPGLLFLPDLPSAPFVPRDAQRHDVELLESSFPAILRDFGAVSWDFSGTTPPPRGWSPPLAPGCYQLLLYQAGRCQPSNCRRCPGAYRALRGLRSFMSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFAPDP

SEQ ID NO: 1028119 - protein, 367 aa, Homo sapiens; identical to SEQ ID NO: 1028115

SEQ ID NO: 1028120 - protein, 109 aa, Homo sapiens; identical to SEQ ID NO: 1028117

SEQ ID NO: 1028121 - protein, 265 aa, Homo sapiens
AGCHSDVHAVARPDPQVPCWREEGGGTMSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKYFERPFLPFFQQMPFNVVYAVSKAEPYTFPPTSTKHLSIPSKSTVGTQTDYRDADVQTDPYSPEYVVCQDSIPELLTLATLTWGELVNLLTIGR

SEQ ID NO: 1028122 - protein, 86 aa, Homo sapiens
TAVVALGDGAEPLLPAVSQICSPPDSFLVALPFQVFNIFNEWLLQAGIVLGPCNAPVDKADKNPGEKGKVFKLKETSQRASPPVPL

SEQ ID NO: 1028123 - protein, 164 aa, Homo sapiens
QWPPLFTFETRSDVSPSQVICVSSSHATMSSAQGCSVGTVFSHKHLEVPECSPVTLCLNDRHRSPECMRRPRGSTKRAAFPTGALAADTVRYCPPAGSLIGSQCKSLSFSLIHPQSPWSKLQLCTRTPGSSFASSSALTPLSISNISNKSFEGCRGMNTSPLGF

SEQ ID NO: 1028124 - protein, 264 aa, Homo sapiens
QWPPLFTFETRSDVSPSQVICVSSSHATMSSAQGCSVGTVFSHKHLEVPECSPVTLCLNDRHRSPECMRRPRGSTKRAAFPTGALAADTVRYCPPAGSLIGSQCKSLSFSLIHPQSPWSKLQLCTRTPGSSFASSSALTPLSISNISNKSFEGCRGMNTSPLGFCGSVCTLLSTVIPPGGVLAAGAIVVSPVVGLSGVVGGRGVLSSVGRGGGGGGVGIGVGFGVGLVVGLEVGLLVMIGGYDGYNEGGNFGGGNYGGGGNYND

SEQ ID NO: 1028125 - protein, 164 aa, Homo sapiens; identical to SEQ ID NO: 1028123

SEQ ID NO: 1028126 - protein, 164 aa, Homo sapiens; identical to SEQ ID NO: 1028123

SEQ ID NO: 1028127 - protein, 260 aa, Homo sapiens
MALKGRALYDFSQVGTSEGNQDTSRLEDLVIFSETSLDGWLQGQNSRGETGLFPASYVEIVRSGISTNHADYSSSPAGSPGAQVSLYNSPSVASPALSGGGSGFLSNQGSFEEDDDDDWDDWDDGCTVEEEPRAGGLGTNGHPPLNLSYPGAYPSQHMAFRPKPPLERQDSLASAKRGSVVGRNLNRFSCFVRSGVEAFILGDVPMMAKIAETYSIEMGPRGPQWKANPHPFACSVEDPTKQTKFKGIKSYISYKLTPHP

SEQ ID NO: 1028128 - protein, 273 aa, Homo sapiens
RDASIHYCDSADLKKLLTPPADWTLFVPTKDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEDTPVRKLQANKKVQGSRRRLREGRSQ

SEQ ID NO: 1028129 - protein, 181 aa, Homo sapiens
RDASIHYCDSADLKKLLTPPADWTLFVPTKDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYKPFIIYTTFIMMKLALGPAG

SEQ ID NO: 1028130 - protein, 125 aa, Homo sapiens
MKNEEHCPGSFFLCKIRECVLNYRFQLQHPGFQHYLQSSGRRDRGRSEDKKPLEAGVWCWDRGGWDGSSRAVHLLFRGVAHPSLYLFPREDPPRLLFPRLSLLVCEQFWCYSATLLLAPLPASTC

SEQ ID NO: 1028131 - protein, 125 aa, Homo sapiens; identical to SEQ ID NO: 1028130

SEQ ID NO: 1028132 - protein, 78 aa, Homo sapiens
AVGWRCCWQVAYTRLGCQNEEEVKIRNHSKPVSGAGTVVAGTAAVVLSICSSEGWHILASIFSPEKIPLVCSSPVSAF

SEQ ID NO: 1028133 - protein, 1072 aa, Homo sapiens
MQFVSWATLLTLLVRDLAEMGSPDAAAAVRKDRLHPRQVKLLETLGEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNLCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSEVRWEGCYFP

SEQ ID NO: 1028134 - protein, 1085 aa, Homo sapiens
MQFVSWATLLTLLVRDLAEMGSPDAAAAVRKDRLHPRQVKLLETLGEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNLCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQPWCQPGEDR

SEQ ID NO: 1028135 - protein, 488 aa, Homo sapiens
MQFVSWATLLTLLVRDLAEMGSPDAAAAVRKDRLHPRQVKLLETLGEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNLCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLE

SEQ ID NO: 1028136 - protein, 370 aa, Homo sapiens
RHINHEYIAKIKSEKGYRKSVAESAGQELSTFAIDSNVSLQVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSEVRWEGCYFP

SEQ ID NO: 1028137 - protein, 88 aa, Homo sapiens
SKARETCTVETQRVTGRFQMIQDILKILPNHKENHQAKSEVGSLDMYWFSLAIDSQFLDIEICWLEILVPKEECLQKEMEQCFCCIGH

SEQ ID NO: 1028138 - protein, 153 aa, Homo sapiens
GCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKVR

SEQ ID NO: 1028139 - protein, 647 aa, Homo sapiens
GCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFTQDG

SEQ ID NO: 1028140 - protein, 464 aa, Homo sapiens
MGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFTQDG

SEQ ID NO: 1028141 - protein, 309 aa, Homo sapiens
MLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFTQDG

SEQ ID NO: 1028142 - protein, 418 aa, Homo sapiens
DPKSDSSAKRKPFILPKKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFTQDG

SEQ ID NO: 1028143 - protein, 534 aa, Homo sapiens
GCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLK

SEQ ID NO: 1028144 - protein, 171 aa, Homo sapiens
MGLSVVLKLSSVLGLHADIVAPQAGPRSRPSPLFSHLGAASLVPTHKHEVHITPCHPCFSVEVAIAEFEGPVSSVAGMLPVCSHLCPKISLHKMVELTVAARQAYKTMLENVQQELVGEPRPQAPPSLPTQGPSCPAEDGPPALKEKEEPHYSECLRESCVRSSVLLFTDL

SEQ ID NO: 1028145 - protein, 309 aa, Homo sapiens; identical to SEQ ID NO: 1028141

SEQ ID NO: 1028146 - protein, 467 aa, Homo sapiens
MPLPILLHVQALSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFTQDG

SEQ ID NO: 1028147 - protein, 103 aa, Homo sapiens
MMGPRISLHKMVELTVAARQAYKTMLENVQQELVGEPRPQAPPSLPTQGPSCPAEDGPPALKEKEEPHYIEIWKKHLEAYSGCTLELEESLEASTSQMMNLNL

SEQ ID NO: 1028148 - protein, 311 aa, Homo sapiens
GCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERLWGFFFCFS

SEQ ID NO: 1028149 - protein, 99 aa, Homo sapiens
SLSAPWDVSSLSVYEETVLSPPLYLGPRLPLPSGFTLNSQVQQTIALRYACSKLGINFDSFVACMIRLETLFKLFSLLDEDKDGMVQLSLAEWLCCVLV

SEQ ID NO: 1028150 - protein, 140 aa, Homo sapiens
SSQEKEICKACRIWTQSCWSLMCLEQRVLGTLGAVEFKTLWLKIQKYLEIYWETDYNHSGTIDAHEMRTALRKAGFTLNSQVQQTIALRYACSKLGINFDSFVACMIRLETLFKLFSLLDEDKDGMVQLSLAEWLCCVLV

SEQ ID NO: 1028151 - protein, 246 aa, Homo sapiens
MRTALRKAGFTLNSQVQQTIALRYACSKLGINFDSFVACMIRLETLFKLFSLLDEDKDGMVQLSLAERLRCMSPDPGLQISFFFPAPLTATWHPHFFFLHTCSSDIHWLPDPPPPATPPPALSPEVCTPDPPGPKDAQPQTTDASPRTPYPLFCNNTTESYPPHRLDDAHSPPHHTPRVPSSRPLDPPPYAPPHSATTPHPPRPPYPQYHLRHPPHPTRQAHTAARTRQNTHPAAAQIERTPEAPT

SEQ ID NO: 1028152 - protein, 82 aa, Homo sapiens
MEDMNEYSNIEEFAEGSKINASKNQQDDGKMFIGGLSWDTSKKDLTEYLARFGEVVDCTSDAASADVLELREHRLDGQLRVP

SEQ ID NO: 1028153 - protein, 343 aa, Homo sapiens
RRAAEAAAEAAAGEPGGAERAAGTSRRRGLRACDEEFACPELEALFRGYTLRLEQAATLKALAVLSLLAGALALAELLGAPGPAPGLAKGSHPVHCVLFLALLVVTNVRSLQVPQLQQVGQLALLFSLTFALLCCPFALGGPPGGSAGAAGGPATAEQGVWQLLLVTFVSYALLPVRSLLAIGFGLVVAASHLLVTATLVPAKRPRLWRTLGANALLFGGVTMYGGLGGILTERQRKGSLQARSCIEGPMRLEDENEKQERRPHEASCPGRLPGDFTGDVLKPLGRISPRFYFRGGTCWSSGGGHDGVTAVGSHVRARRGWEELQDDMRERVDNTGDNKGHQT

SEQ ID NO: 1028154 - protein, 183 aa, Homo sapiens
DDACRARLGLGVRPGARGSYGDGKRGPRRRLTGVGPGGGGVEQQYAKGGKGSAVPSDSQAREKLALYVYEYLLHIGAQKSAQTFLSEIRWEKNIMPSPGDSTNSSENMYTIMNPIGQGAGRANFPLGPGPEGRMAAMSTMEPHHVNGSLGSGDMDGLPKSSPGAVAALSNAPGTPRDDGEMAA

SEQ ID NO: 1028155 - protein, 257 aa, Homo sapiens
PDTISLVCPGNSYDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 1028156 - protein, 430 aa, Homo sapiens
MTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVETITSIYSVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 1028157 - protein, 235 aa, Homo sapiens
FFQCLHEIVNLFKLNVWTVDYLMQAVEKDPTHHIKKYRAVFAQGKGVAWPKAATFNEQQSIPVTTAEQWARKTLQSIENRMTFTLYVRVKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 1028158 - protein, 421 aa, Homo sapiens
MTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 1028159 - protein, 421 aa, Homo sapiens; identical to SEQ ID NO: 1028158

SEQ ID NO: 1028160 - protein, 421 aa, Homo sapiens; identical to SEQ ID NO: 1028158

SEQ ID NO: 1028161 - protein, 249 aa, Homo sapiens
MRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 1028162 - protein, 238 aa, Homo sapiens
AEAIRGSPLVCKCLEEVTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 1028163 - protein, 272 aa, Homo sapiens
KEIKRGHKQMEKIFHAHGKEDINIMKMAILSKVIHRFNAMPIKLPLPFFTELEKKYFKFHMDAKKDPTHHIKKYRAVFAQGKGVAWPKAATFNEQQSIPVTTAEQWARKTLQSIENRMTFTLYDRVKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 1028164 - protein, 421 aa, Homo sapiens; identical to SEQ ID NO: 1028158

SEQ ID NO: 1028165 - protein, 440 aa, Homo sapiens
SINYSNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 1028166 - protein, 362 aa, Homo sapiens
MVSRVKHGYRLAGKYCSPVNCGDSLGVISGQECQLWIRSARPSLVSPGLFAECDVIVSCTRSHLLGAGDITELTRFCDDTRHLETTKVLEDLHQTELGPVLVLAAKWASIRIGTGKVCQGSQPLPAVPPQNIPKRTDVKSQDVAVSPQQQQCSKSYVDRHMESLSQSKSSRRRHNSWSSSSRHPNQATPKKSGLKNGQMKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHKKLLSVAEKHGWDWSLPSSLAWAFPRGIKEKYDSSVFSSFQGHPAHSTQFPRGPQSRGEA

SEQ ID NO: 1028167 - protein, 523 aa, Homo sapiens
MVSRVKHGYRLAGKYCSPVNCGDSLGVISGQECQLWIRSARPSLVSPGLFAECDVIVSCTRSHLLGAGDITELTRFCDDTRHLETTKVLEDLHQTELGPVLVLAAKWASIRIGTGKVCQGSQPLPAVPPQNIPKRTDVKSQDVAVSPQQQQCSKSYVDRHMESLSQSKSSRRRHNSWSSSSRHPNQATPKKSGLKNGQMKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHKKLLSVAEKHGLTLERRLEMTGVCASQMALTLLGGPNRLNPKNVHQRPTVALLCGPHVKGAQGISCGRHLANHDVQVILFLPNFVKMLESITNELSLFSKTQGQQVSSLKDLPTSPVDLVINCLDCPENVFLRDQPWYKAAVAWANQNRAPVLSIDPPVHEVEQGIDAKWSLALGLPLPLGEHAGRIYLCDIGIPQQVFQEVGINYHSPFGCKFVIPLHSA

SEQ ID NO: 1028168 - protein, 339 aa, Homo sapiens
MVSRVKHGYRLAGKYCSPVNCGDSLGVISGQECQLWIRSARPSLVSPGLFAECDVIVSCTRSHLLGAGDITELTRFCDDTRHLETTKVLEDLHQTELGPVLVLAAKWASIRIGTGKVCQGSQPLPAVPPQNIPKRTDVKSQDVAVSPQQQQCSKSYVDRHMESLSQSKSSRRRHNSWSSSSRHPNQATPKKSGLKNGQMKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHCYPTALCLEGSCAGRTLLSPAAPDNKRLKDMKLHGPC

SEQ ID NO: 1028169 - protein, 523 aa, Homo sapiens; identical to SEQ ID NO: 1028167

SEQ ID NO: 1028170 - protein, 523 aa, Homo sapiens; identical to SEQ ID NO: 1028167

SEQ ID NO: 1028171 - protein, 97 aa, Homo sapiens
SFTVRTDTGEPMGRGTKVILHLKEDQTEYLEERRIKEIVKKHSQFIGYPITLFVEKERDKEVSDDEAEEKEDKEEEKEIEEEESEAVWRYRRSIRIC

SEQ ID NO: 1028172 - protein, 91 aa, Homo sapiens
SFTVRTDTGEPMGRGTKVILHLKEDQTEYLEERRIKEIVKKHSQFIGYPITLFVEKERDKEVSDDEAEEIGRQRTRIGKRTERVVRHYRGR

SEQ ID NO: 1028173 - protein, 100 aa, Homo sapiens
SFTVRTDTGEPMGRGTKVILHLKEDQTEYLEERRIKEIVKKHSQFIGYPITLFVEKERDKEVSDDEAEETGKHPSTARHKKQQAAKSRQDKPAHCTACPV

SEQ ID NO: 1028174 - protein, 75 aa, Homo sapiens
MSSAPNRVWDINKLRNVLHKSQFIGYPITLFVEKERDKEVSDDEAEEKEDKEEEKEIEEEESEAVWRYRRSIRIC

SEQ ID NO: 1028175 - protein, 110 aa, Homo sapiens
MMASGWSVELLERLDPAHIWKELAPQCLPTSQQGAHYPQKELLRTHDAGPVLDYRIFSSLAPRLPVERVEPAITETEHRPRVPLPDLDVCLQSTHQLCPSLDRDIFVVLR

SEQ ID NO: 1028176 - protein, 147 aa, Homo sapiens
MARGLMKAPPFPPCAFLAGREGEKGSPDLHPSLLHLPWSVHLQAAHSSPPLDTHLPRHNSLPHAHICQELAPQPLPTSHHAAYYPHRELLLTHAAPPALPYSIFSSLAPRLPVERVEPAITETEHRPRVPLPDLDVASRARTSSVPL

SEQ ID NO: 1028177 - protein, 341 aa, Homo sapiens
SSEPNDARVRASGPGAPGRSSRGAVWVGAWRWARAAAGTSPLPRAAPARDRGDAKQRVRDVYDYFRAVLQRDERSERAFKLTRDAIELNAANYTVWHFRRVLLKSLQKDLHEEMNYITAIIEEQPKNYQVWHHRRVLVEWLRDPSQELELLLIFLIRMQRIIMPGSIDNGLFRNLNFGDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 1028178 - protein, 341 aa, Homo sapiens
MAAEAGEAVASPMDDGFVSLDSPSYVLYRDRAEWADIDPVPQNDEPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQDLNFGDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 1028179 - protein, 341 aa, Homo sapiens; identical to SEQ ID NO: 1028178

SEQ ID NO: 1028180 - protein, 179 aa, Homo sapiens
MAAEAGEAVASPMDDGFVSLDSPSYVLYRDRAEWADIDPVPQNDEPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWG

SEQ ID NO: 1028181 - protein, 341 aa, Homo sapiens; identical to SEQ ID NO: 1028178

SEQ ID NO: 1028182 - protein, 364 aa, Homo sapiens
RGGSATTSAADRGEMAATEGVGEAAQGGEPGQPAQPPPQPHPPSPQQQHKEEMAAEAGEAVASPMDDGFVSLDSPSYVLSVRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQDLNFGDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 1028183 - protein, 332 aa, Homo sapiens
MAAEAGEAVASPMDDGFVSLDSPSYVLYRDRAEWADIDPVPQNDEPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQDLNFGDNELQYVDQLLKEDVRNNSVWNQRYFVISNTTGYNDRAVLEREVQYTLEMIKLVPHNESAWNYLKGILQDRGLSKYRYVLNPGVDVQPSHSAARPDELLSEDMYGDRIGYHYDKKVDMIKSGSYENMSDTIVQDNNTMSEGELDRPQVDPGRAN

SEQ ID NO: 1028184 - protein, 183 aa, Homo sapiens
RGGSATTSAADRGEMAATEGVGEAAQGGEPGQPAQPPPQPHPPSPQQQHKEEMAAEAGEAVASPMDDGFVSLDSPSYVLSVRDVYDYFRAVLQRDERSERAFKLTRDAIELNAANYTVWHFRRVLLKSLQKDLHEEMNYITAIIEEQPKNYQVWHHRRVLVEWLRDPSQRNDVCCTCMGLDTI

SEQ ID NO: 1028185 - protein, 356 aa, Homo sapiens
MPILKQLVSSSVHSKRRSRADLTAEMISAPLGTFRHTMHVGRAGDAFGDTSFLNSKAGEPDGESLDEQPSSSSSKRSLLSRKFRGSKRSQSVTRGEREQRDMLGSLRDSALFVKNAMSLPQLNEKEAAEKGTSKLPKSLSSSPVKKANDGEGGDEEAGTEEAVPRRNGAAGPHSPDPLLDEQAFGDLTDLPVVPKATYGLKHAESIMSFHIDLGPSMLGDVLSIMDKEEWDPEEGEGGYHGDEGAAGTITQAPPYAVAAPPLARQEGKAGPDLPSLPSHALEDEGWATAAPSPGSTRSMGSHTTRDSSSLSSCTSGILEERSPAFRGPDRARAAVSRQPPDKEFSFMDEEEEDEIV

SEQ ID NO: 1028186 - protein, 356 aa, Homo sapiens
MPILKQLVSSSVHSKRRSRADLTAEMISAPLGDFRHTMHVGRAGDAFGDTSFLNSKAGEPDGESLDEQPSSSSSKRSLLSRKFRGSKRSQSVTRGEREQRDMLGSLRDSALFVKNAMSLPQLNEKEAAEKGTSKLPKSLSSSPVKKANDGEGGDEEAGTEEAVPRRNGAAGPHSPDPLLDEQAFGDLTDLPVVPKATYGLKHAESIMSFHIDLGPSMLGDVLSIMDKEEWDPEEGEGGYHGDEGAAGTITQAPPYAVAAPPLARQEGKAGPDLPSLPSHALEDEGWAAAAPSPGSARSMGSHTTRDSSSLSSCTSGILEERSPAFRGPDRARAAVSRQPDKEFSFMDEEEEDEIRV

SEQ ID NO: 1028187 - protein, 356 aa, Homo sapiens; identical to SEQ ID NO: 1028185

SEQ ID NO: 1028188 - protein, 294 aa, Homo sapiens
MRDASIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPHTHTQLEGENSMGYDRREGDLETVYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQITECTVFAAEQGLKPGILEKVFLTTSAHTEAGLALFNLAAVKKHNLLAKGSPLGWELVVPI

SEQ ID NO: 1028189 - protein, 254 aa, Homo sapiens
MRDASIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPHTHTQLEGENSMGYDRREGDLETVYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQITECTVFAAEQCEAVCRCEGF

SEQ ID NO: 1028190 - protein, 254 aa, Homo sapiens
MRDASIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPHTHTQLEGENSMGYDRREGDLETVYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQITECTVFAAEQSVKQYSGKFF

SEQ ID NO: 1028191 - protein, 252 aa, Homo sapiens
MRDASIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPHTHTQLEGENSMGYDRREGDLETVYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTHHHAWLIFCSFCRGGRRWKVRL

SEQ ID NO: 1028192 - protein, 254 aa, Homo sapiens; identical to SEQ ID NO: 1028190

SEQ ID NO: 1028193 - protein, 187 aa, Homo sapiens
ATQPRPPARAQATQGGREGQARTLGPAAPTVDSNLSSEARPVTSFLSLSQVSGPQLPGEGEEEEEGEDDGAPGDEAASEDSEEAAGPALGRWREDAIDWQRTFSVGAVDFELLRSDWNDLRCNVSGNLQLPEAEAVDVTAQYMERLNARHGGRFALLRIVNVEKRRDSARGSRFLLELELQERGGGR

SEQ ID NO: 1028194 - protein, 112 aa, Homo sapiens
MGLGSLVCPQSCPDPGGGGWKVDLPAGPTWRGRCCAAEPAASANSKSAEFLWPGRTQGCGRGAGWKPQYRLTAEPCRRFALLRIVNVEKRRDSARGSRFLLELELQERGGGR

SEQ ID NO: 1028195 - protein, 217 aa, Homo sapiens
MPRLPVKKIRKQMKLLLLLLLLSCAAWLTYVHLGLVRQGRALRQRLGYGRDGEKLTSETDGRGVHAVPSTQRAEDSSESREEEQAPEGRDLDMLFPGGAGRLPLNFTHQTPPWREEYKGQVNLHVFEDWCGGAVGGRRGLRAAALGLERPAMQRFGEPAAAGGGGRGRDRSVHGAAERAPRRALRASAHRERGEAPGLGARESLPAGAGAAGARGRP

SEQ ID NO: 1028196 - protein, 465 aa, Homo sapiens
MPRLPVKKIRKQMKLLLLLLLLSCAAWLTYVHLGLVRQGRALRQRLGYGRDGEKLTSETDGRGVHAVPSTQRAEDSSESREEEQAPEGRDLDMLFPGGAGRLPLNFTHQTPPWREEYKGQVNLHVFEDWCGGAVGHLRRNLHFPLFPHTRTTVKKLAVSPKWKNYGLRIFGFIHPARDGDVQFSVASDDNSEFWLSLDESPAAAQPCGLLWGKTGSEWTAPGEFTKFSSQVSKPRRLMASRRYYFELLHKQDDRGSDHVEVGWRAFLPGLKFEVISSAHISLYTDESALKMDHVAHVPQSPASHVGGRPPQEETSADMLRPDPRDTFFLTPRMESSSLENVLEPCAYAPTYVVKDFPIARYQGLQFVYLSFVYPNDYTRLTHMETDNKCFYRESPLYLERFGFYKYMKMDKEEGDEDEEDEVQRRAFLFLNPDDFLDDEDEGELLDSLEPTEAAPPRSGPQIHGC

SEQ ID NO: 1028197 - protein, 177 aa, Homo sapiens
ATQPRPPARAQATQGGREGQARTLGPAAPTVDSNLSSEARPVTSFLSLSQVSGPQLPGEGEEEEEGEDDGAPGDEAASEDSEEAAGPALGRWREDAIDWQRTFSVGAVDFELLRSDWNDLRCNVSGNLQLPEAEAVDVTAQYMERLNARHGGYGGGRTRARAVLEAGTAGEMEVLAL

SEQ ID NO: 1028198 - protein, 122 aa, Homo sapiens
MPRLPVKKIRKQMKLLLLLLLLSCAAWLTYVHLGLVRQGRALRQRLGYGRDGEKLTSETDGRGVHAVPSTQRAEDSSESREEEQAPEGRDLDMLFPGGAGRLPLNFTHQTPPWREEVSWLGL

SEQ ID NO: 1028199 - protein, 489 aa, Homo sapiens
MPRLPVKKIRKQMKLLLLLLLLSCAAWLTYVHLGLVRQGRALRQRLGYGRDGEKLTSETDGRGVHAVPSTQRAEDSSESREEEQAPEGRDLDMLFPGGAGRLPLNFTHQTPPWREEYKGQVNLHVFEDWCGGAVGHLRRNLHFPLFPHTRTTVKKLAVSPKWKNYGLRIFGFIHPARDGDVQFSVASDDNSEFWLSLDESPAAAQPCGLLWGKTGSEWTAPGEFTKFSSQVSKPRRLMASRRYYFELLHKQDDRGSDHVEVGWRAFLPGLKFEVISSAHISLYTDESALKMDHVAHVPQSPASHVGGRPPQEETSADMLRPDPRDTFFLSERGPARGRGQGCLPQPPCDPPPAAPRMESSSLENVLEPCAYAPTYVVKDFPIARYQGLQFVYLSFVYPNDYTRLTHMETDNKCFYRESPLYLERFGFYKYMKMDKEEGDEDEEDEVQRRAFLFLNPDDFLDDEDEGELLDSLEPTEAAPPRSGPQIHGC

SEQ ID NO: 1028200 - protein, 941 aa, Homo sapiens [sequence omitted]

SEQ ID NO: 1028201 - protein, 112 aa, Homo sapiens
KILYHLQGAGNPQLGIPPGPWQFLRKNWNKLVQKFELGSSSIAHMVMGTTNQFSTRTRLEEVKGFFSSLKENGSQLRCVQQTIETIEENIGWMDKNFDKIRVWLQSEKLERM

SEQ ID NO: 1028202 - protein, 66 aa, Homo sapiens
GRVGRPTRPGEHAAVLVVVSAATQAGPGGGAVGESAKAAEVRGRGVEGPRELGEKGVNPQDPTCRD

SEQ ID NO: 1028203 - protein, 114 aa, Homo sapiens
MLASDYNFPVLSRFRNANRSFGLHFYFLPSVPSLSNYMLIEQAGGPQSRPESLWGLLHLVGITGLISTLHGALIEVLFIFFMLIGLFLDWILPVIPAINSYKLWTQNFHDTFSK

SEQ ID NO: 1028204 - protein, 111 aa, Homo sapiens
MAASSSSSSAGGVSGSSVTGSGFSVSDLAPPRKALFTYPKGAGEMLEDDGSERFLCESVFSYQVASTLKQVKHDQQVARMEKLAGLVEELEADEWRFKPIEQLLGFTPSSG

SEQ ID NO: 1028205 - protein, 111 aa, Homo sapiens; identical to SEQ ID NO: 1028204

SEQ ID NO: 1028206 - protein, 111 aa, Homo sapiens; identical to SEQ ID NO: 1028204

SEQ ID NO: 1028207 - protein, 111 aa, Homo sapiens; identical to SEQ ID NO: 1028204

SEQ ID NO: 1028208 - protein, 111 aa, Homo sapiens; identical to SEQ ID NO: 1028204

SEQ ID NO: 1028209 - protein, 111 aa, Homo sapiens; identical to SEQ ID NO: 1028204

SEQ ID NO: 1028210 - protein, 114 aa, Homo sapiens; identical to SEQ ID NO: 1028203

SEQ ID NO: 1028211 - protein, 111 aa, Homo sapiens; identical to SEQ ID NO: 1028204

SEQ ID NO: 1028212 - protein, 83 aa, Homo sapiens
TPPSPLAPSVGGRTRRGPRRDGSERFLCESVFSYQVASTLKQVKHDQQVARMEKLAGLVEELEADEWRFKPIEQLLGFTPSSG

SEQ ID NO: 1028213 - protein, 68 aa, Homo sapiens
GRVGRPTRPGEHAAVLVVVSAATQAGPGGGAVGESAKAAEVQWLTPVIPALWEAKAGGSPEVGSSRPA

SEQ ID NO: 1028214 - protein, 75 aa, Homo sapiens
DAAFAAGSVCWGANTPRSSSCEVRTLLERKWLLHHHPPQLVGSVEVLSLDLVSVSQTLPHHGKPFSPTPKELERC

SEQ ID NO: 1028215 - protein, 166 aa, Homo sapiens
MAASSSSSSAGGVSGSSVTGSGFSVSDLAPPRKALFTYPKGAGEMLEDDGSERFLCESVFSYQVASTLKQVKHDQQVARMEKLAGHRAAAGIHPLFRLILPGWSPLVRSKCKASGGLSHSLHSHPEIHSYVTELLMHICTWFLCIYSQATNTYMCDLSGNVLFICF

SEQ ID NO: 1028216 - protein, 155 aa, Homo sapiens
MAASSSSSSAGGVSGSSVTGSGFSVSDLAPPRKALFTYPKGAGEMLEDDGSERFLCESVFSYQVASTLKQVKHDQQVARMEKLAGCGRRAGWSPLWRSKCKASGGLSHSLHSHPEIHSYVTELLMHICTWFLCIYSQATNTYMCDLSGNVLFICF

SEQ ID NO: 1028217 - protein, 111 aa, Homo sapiens; identical to SEQ ID NO: 1028204

SEQ ID NO: 1028218 - protein, 66 aa, Homo sapiens; identical to SEQ ID NO: 1028202

SEQ ID NO: 1028219 - protein, 114 aa, Homo sapiens; identical to SEQ ID NO: 1028203

SEQ ID NO: 1028220 - protein, 111 aa, Homo sapiens; identical to SEQ ID NO: 1028204

SEQ ID NO: 1028221 - protein, 111 aa, Homo sapiens; identical to SEQ ID NO: 1028204

SEQ ID NO: 1028222 - protein, 111 aa, Homo sapiens; identical to SEQ ID NO: 1028204

SEQ ID NO: 1028223 - protein, 111 aa, Homo sapiens; identical to SEQ ID NO: 1028204

SEQ ID NO: 1028224 - protein, 111 aa, Homo sapiens; identical to SEQ ID NO: 1028204

SEQ ID NO: 1028225 - protein, 111 aa, Homo sapiens; identical to SEQ ID NO: 1028204

SEQ ID NO: 1028226 - protein, 68 aa, Homo sapiens; identical to SEQ ID NO: 1028213

SEQ ID NO: 1028227 - protein, 111 aa, Homo sapiens; identical to SEQ ID NO: 1028204

SEQ ID NO: 1028228 - protein, 71 aa, Homo sapiens
GRRLRRWLRLLGGEHAAVLVVVSAATQAGPGGGAVGESAKAAEVQWLTPVIPALWEAKAGGSPEVGSSRPA

SEQ ID NO: 1028229 - protein, 68 aa, Homo sapiens; identical to SEQ ID NO: 1028213

SEQ ID NO: 1028230 - protein, 251 aa, Homo sapiens
ERTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEEEFNDYEANDPWVQQFILNLEQQMAEFKASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 1028231 - protein, 251 aa, Homo sapiens; identical to SEQ ID NO: 1028230

SEQ ID NO: 1028232 - protein, 223 aa, Homo sapiens
ERTDEAKMSFLVTLNNVEVCSENISTLKKTLESDCTKLFSQGIGGEQAQAKFDSCLSDLAAVSNKFRDLLQEGLTELNSTAIKPQVQPWINSFFSVSHNIEEASLSPVIYDSLTGLMTSLVAVELEKVVLKSTFNRLGGLQFDKELRSLIAYLTTVTTWTIRDKFARLSQMATILNLERVTEILDYWGPNSGPLTWRLTPAEVRQVLALRIDFRSEDIKRLRL

SEQ ID NO: 1028233 - protein, 139 aa, Homo sapiens
PRPPLWQSLLRGEGIGESTLGIYRYMALQHPTEVTLAHQKWIHNLKTLTERPVHDYRSVATKLNGKGPEIAMVQGLEKEPEVMQRWMETRFQGGMTGLRRMSEHSRKHRSRYGTENALSVEPVHLRNWYSYSLITDVSG

SEQ ID NO: 1028234 - protein, 54 aa, Homo sapiens
MAQYPCDDLGVVSSLNKDTNGGDQVEHCRYEGSEEITPGPVDEWYLGVQVTHVD

SEQ ID NO: 1028235 - protein, 272 aa, Homo sapiens
MREVHIQAGQCGNQIGAKFWEVISDEHGIDPTGSYYWRQLFAAGENQCLLSMKLLVTNMFLGPSWWIWSLAPWIRLGLARAILVDLEPGTMDSVLFRSGPFGQIFRPDNFVFGQSGAGNNWAKGHYTEGAELVDSVLDVVRKESESCDCLQGFQLTHSLGGGTGSGMGTLLISIREYPDRIMNTFSVMPSPKVSDTVVEPYNATLSVHQLVENTDETYCIDNEALYDICFRTLKLTTPTYGDLNHLVSATMSGVTTCLRFPGQLNADLRNWR

SEQ ID NO: 1028236 - protein, 251 aa, Homo sapiens
MREVHIQAGQCGNQIGAKFWEVISDEHGIDPTGSYYGDIDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISIREYPDRIMNTFSVMPSPKVSDTVVEPYNATLSVHQLVENTDETYCIDNEALYDICFRTLKLTTPTYGDLNHLVSATMSGVTTCLRFPGQLNADLRNWR

SEQ ID NO: 1028237 - protein, 57 aa, Homo sapiens
KITLRDGTEDLSLVLAVPKHVSQEQDLLGEGGQGPAEPSRCVSWRDFGGVWSQTKTI

SEQ ID NO: 1028238 - protein, 530 aa, Homo sapiens
MAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 1028239 - protein, 121 aa, Homo sapiens
VTRRRSRALLRMLPGDGLCPGFLPSDLPIGCGSGGPFLCLHHPVCGPSLGCHHRPPGGPLHQQIPLDLPGSPYALVSRICPFEVAQGRTSSISAPWSFSLSCHRQKGEEKEGVKSPRVLKP

SEQ ID NO: 1028240 - protein, 500 aa, Homo sapiens
TTGAPAPAVFSVASNLASIAILVVSIYRGGTLNSRRNKKLQQLIFAVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 1028241 - protein, 530 aa, Homo sapiens; identical to SEQ ID NO: 1028238

SEQ ID NO: 1028242 - protein, 725 aa, Homo sapiens
GAAECVPRLPAGLASARRPWLRLLRSELGRSSGLRGRGASRLPGPKRRGPRVMAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWEVYTGPPPRVSPAPSPQFCSSLGRVLCSVLPQAILWVQVRSGGGLSCTVVQVVSFARTPSRMKNGGCNLAWAPLATLSTSKQGYFLLEQEAFSYSCEGPISSLSCVPMVLASFQRGHLFLIKHRGPVRWGSVLMGCSLLLAAGSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 1028243 - protein, 662 aa, Homo sapiens
GAAECVPRLPAGLASARRPWLRLLRSELGRSSGLRGRGASRLPGPKRRGPRVMAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALGTRPAALAAQKQTPQSWLASSRARHVARSHHAEGHRRDQDLSAGLLSSWTAGARKGTEDSRRWPRTLAVLTVGPAALWPPASPLPACGAKPWGCHCEYAKD

SEQ ID NO: 1028244 - protein, 236 aa, Homo sapiens
RSSRGSQPSALLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 1028245 - protein, 154 aa, Homo sapiens
MESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 1028246 - protein, 460 aa, Homo sapiens
GAAECVPRLPAGLASARRPWLRLLRSELGRSSGLRGRGASRLPGPKRRGPRVMAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVGSGIRVEAASYNLVKLLMS

SEQ ID NO: 1028247 - protein, 154 aa, Homo sapiens; identical to SEQ ID NO: 1028245

SEQ ID NO: 1028248 - protein, 223 aa, Homo sapiens
GAAECVPRLPAGLASARRPWLRLLRSELGRSSGLRGRGASRLPGPKRRGPRVMAKGEGAESGSAAGLLPTSILQSTERPAQVKVRARHPAWRARGGRRRKWGIRGVPGSAWSGDHWDSQGQEAYEPERTWGCPGTGGDGEKLWAPSPPFAHPHSTLCGEALPAAPCDSPLCLAGFHSSVLSGWGLPPQTPEMTPEIWETPLGSPSLIPYLPLHPPTLAPQLCC

SEQ ID NO: 1028249 - protein, 613 aa, Homo sapiens
GAAECVPRLPAGLASARRPWLRLLRSELGRSSGLRGRGASRLPGPKRRGPRVMAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISVSGVEEQSLGGVGMSGGNLPADSSSCTPFPESAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 1028250 - protein, 427 aa, Homo sapiens
GAAECVPRLPAGLASARRPWLRLLRSELGRSSGLRGRGASRLPGPKRRGPRVMAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISVSGVEEQSLG

SEQ ID NO: 1028251 - protein, 590 aa, Homo sapiens
GAAECVPRLPAGLASARRPWLRLLRSELGRSSGLRGRGASRLPGPKRRGPRVMAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSVASCLPSACLWGQALGLPL

SEQ ID NO: 1028252 - protein, 455 aa, Homo sapiens
GAAECVPRLPAGLASARRPWLRLLRSELGRSSGLRGRGASRLPGPKRRGPRVMAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPW

SEQ ID NO: 1028253 - protein, 447 aa, Homo sapiens
GAAECVPRLPAGLASARRPWLRLLRSELGRSSGLRGRGASRLPGPKRRGPRVMAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMEVGLLQMEVVNDIRQHGP

SEQ ID NO: 1028254 - protein, 114 aa, Homo sapiens [sequence omitted]

SEQ ID NO: 1028255 - protein, 203 aa, Homo sapiens
MALLRSGRVLPGIVLRLPPGPRRRGALPEPAPGGPMWRMGPPDPILGVTEAFKRDTKSIKMNLGVGAYRDDNGKPYVLAYASARQRPRLPQKHLDKEYLPIGGLAEFCKASAELALGENSEVLKSGRFVTVQNHFWNWSLNGSEPSLLQRFYKFSRDVFLPKATWGNHTPIFRDAGMQLQGYRYYDPRLAVLTSPGACGGYIK

SEQ ID NO: 1028256 - protein, 339 aa, Homo sapiens
MESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 1028257 - protein, 313 aa, Homo sapiens
MESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLEAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 1028258 - protein, 89 aa, Homo sapiens
RHAGVSQSPLSKRTGPLCLVSRLSNEIAFFFSVAPKLSYPLGAQGSKTSSFKKEPCPRLVKQKPRSLKGRAIDNFRVDRALNLLRKERN

SEQ ID NO: 1028259 - protein, 81 aa, Homo sapiens
RAHISPLISLREVMDGSQLRVHVGNAVRQTIHLGFANHSYHIGCYKQAPPWIENSGSAPLVKGRAQMCGGEQFNLLRKERN

SEQ ID NO: 1028260 - protein, 110 aa, Homo sapiens
MEYDSALEELAEVVITTVRWYAGSLRKRRRENERDLMVCYMYGRAGPQSGYVVVYDVVQQLRESWIVSIVSVSRSSEDKIIRALRYERDQRSEVYGRSYICGILRFASVG

SEQ ID NO: 1028261 - protein, 134 aa, Homo sapiens
ARARRIRTRRLVDLSSPVCTLRMIRCVRAGRIKVMWGGVIIGRVVRIIDCGGRPGGRSCNVRFPCGFDAGLTQLLNVVAAEPMDLTGGEECGSYYVVVMDGYNVSVGRPALKRERFTLQFVNKRVRAAVTRIGE

SEQ ID NO: 1028262 - protein, 88 aa, Homo sapiens
LNRTIDVCGARGGVIGDRPACDPRETVVYEQIAAVTASVELVHPERPNKVATGAQWTSDDDAKRTSLVGSWCGVRKHGGEKEAVENKT

SEQ ID NO: 1028263 - protein, 119 aa, Homo sapiens
MIEVGGGVQSGDEAANKADEVYTMIVVCTLGERWYKSFIWGVSLLSMSRPMVRGWAGHDVEEEGDRRRLMMDVLLSGVYWVWGEEEVEKWSQCWVKKERNNFGLRYQESKISLWHFGLG

SEQ ID NO: 1028264 - protein, 231 aa, Homo sapiens
RGRVSGRVDEDTYASYLEPVAHDAARLADRTHNHLRGGVGRRCQGAGGRSQDPRAGVYSDNETNRKSTIGLRVVTPIGPRTALGVCVCYIGGDAIATVSRRAGGPALSRRAPARRNFSGVQPRSDRYFRGGGGARARNWARGRNGAVRSHGHTTAWRGEASCDQVCYGSYTGGSVIMSIGHSRLLETRRRDTVMMSIHLFPFCFQRDGSCYRCANSYVFFRDHASFQCIVK

SEQ ID NO: 1028265 - protein, 68 aa, Homo sapiens
TGFQGTVSLESGDSPMADCKTDAGAVGLIILNKSLFAVSRLRRVPQFCYGCPYCGISYIALSRVKRVA

SEQ ID NO: 1028266 - protein, 157 aa, Homo sapiens
PGDTRSHGRRTFMRGREPLVCAVTRATAIPRNPSHQRPPASRGARGSHILGHISSLAPPDRADARANTPPPRSPPRARLGASSTHVYYREAVQHYTNGTASSIRVRRASRAHRRASPRRSGPPPLPPPGVFQPLGAILKYASRALDIILRASLAQPP

SEQ ID NO: 1028267 - protein, 139 aa, Homo sapiens
YFLQAQGAKVKGSKGAVRLGPQGKEGEGPRSRGWVFYGGKMTRSLRGQMEKLRICGSAVLMGCVCPQKYSPKEDKYEEEINLLEEKLKEAETRAEFAERSVAKLEKTIDDLEEPLASAKEENVEIHQTLDQTLVELNNL

SEQ ID NO: 1028268 - protein, 138 aa, Homo sapiens
QLKEAKHIVEYSGRKYEEVARKLVILEGELERSEERSEVSDSRAKQLEEDLRIVDEALKSLKAPEEEYSPKEDKYEEEINLLEEKLKEAETRAEFAERSVAKLEKTIDDLEEPLASAKEENVEIHQTLDQTLVELNNL

SEQ ID NO: 1028269 - protein, 230 aa, Homo sapiens
QPAGSPVSCPRACVAPVPVAPVPVAPLPPLTMGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIIQQLAR

SEQ ID NO: 1028270 - protein, 216 aa, Homo sapiens
QPAGSPVSCPRACVAPVPVAPVPVAPLPPLTMGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVRLGPGGGRGCLFLAPWLCLRAWRVLASLLALGLRCACISRLVVLVHSRGVYMM

SEQ ID NO: 1028271 - protein, 375 aa, Homo sapiens
QPAGSPVSCPRACVAPVPVAPVPVAPLPPLTMGPGPRLLLPLVLCVGLGALVFSSGAEGFRKRGPSVTAKVFFDVRIGDKDVGRIVIGLFGKVVPKTVENFVALATGEVCLNFISFKLGLLSLKPNIKMSSEKISIKLVCQMNLTTFDFIFQLNMYYLGTQCPEASGNWEKIIIKGKYGLLSFNLFTLILYFHNIFIFWSANDKFLSVNHSWDIIKFCRHLFEFSQFVLSRSTLSLSFSMASVTCYSTEAISLKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIIQQLAR

SEQ ID NO: 1028272 - protein, 214 aa, Homo sapiens
MVIAVALAISWSSRSAGISPPIRMARGAPGRSDEGPECCPELSSLSSIRQESHVESSSDSDYRPRSGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIIQQLAR

SEQ ID NO: 1028273 - protein, 239 aa, Homo sapiens
QPAGSPVSCPRACVAPVPVAPVPVAPLPPLTMGPGPRLLLPLVLCVGLGALVFSSGAEGFRKRGPSVTAKVFFDVRIGDKDVGRIVIGLFGKVVPKTVENFVALATGEVKPVYEPSLLKSRAKEHSCKDDCTSLRRMEFGDSSSSISTGVSIYGETFPDENFKLKHYGIGWVSMANAGPDTNGSQFFITLTKPTWLDGKHVVFGKVIDGMTVVHSIELQATDGHDRPLTNCSIIQQLAR

SEQ ID NO: 1028274 - protein, 171 aa, Homo sapiens
MNDKLRFADGSIRTSELRLSMQSENAAVFRVGSLQEGCGKISKYGVKRKTFDRGMGGNTGLPEPDPQLMLCARQTIGGERKESRGAHAREDYKSNKKRDGVSGIQVRIDEYDYSKPIQRLQKKPYEEHWRKHTLSYVDVGTGKVTLEYRPVIDKTLNEADCATVPPAIRSY

SEQ ID NO: 1028275 - protein, 200 aa, Homo sapiens
MNDKLRFADGSIRTSELRLSMQSENAAVFRVGSLQEGCGKISKYGVKRKTFDRGMGGNTGLPEPDPQLMLCARQTIGGERKESRGAHAREDYKVRIDEYDYSKPIQRLQKKPYEEHWRKHTLSYVDVGTGKVTLEYRPVIDKTLNEADCATAPASHSLLLMRQDVVMTESAFVIMYNSSCMCPCHNCLHTLLHSGEEGVH

SEQ ID NO: 1028276 - protein, 125 aa, Homo sapiens
MLTEVMEVWHGLVIAVVSLFLQACFLTAINYLLSRHMDDSDTPSDSLDSSCSSPPACQATEDVDYTQVVFSDPGELKNDSPLDYENIKEITDYVNVNPEKTQAQFSGILATLLWLSQAEYEQGGM

SEQ ID NO: 1028277 - protein, 173 aa, Homo sapiens
MLTEVMEVWHGLVIAVVSLFLQACFLTAINYLLSRHMAHKSEQILKAASLQVPRPSPGHHHPPAVKEMKETQTERDIPMSDSLYRHDSDTPSDSLDSSCSSPPACQATEDVDYTQVVFSDPGELKNDSPLDYENIKEITDYVKCQSKKTQAQFSGILATLLWLSQAEYEQGGM

SEQ ID NO: 1028278 - protein, 128 aa, Homo sapiens
STYKEARSFLLAALGQLPLEPDCHAVRKPGGSEAAMQMCSRWPWQNLTKSAPATRPASKDALSRRPLQLSSDCPRDTLSEHCPAETRQLQNCERRWFHDFLAVVTAVGQLWVTLKGHSDKGHLPACVT

SEQ ID NO: 1028279 - protein, 121 aa, Homo sapiens
MNHCQLPVVIDNGSGMIKAGVAGCREPQFIYPNIIGRAKGQSLLLAQGWARILCCERPSSGLEELRVFISYPVEALVSLLSLARTVEIMWERISSDYKLKLKPCYGPVLITEPVLKPVANR

SEQ ID NO: 1028280 - protein, 490 aa, Homo sapiens
CFDALVSSPYDRAAGGENSLVIRDCEKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRQEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQSYNATACWSLYKVRNLWTASMLASAPPQEQKQMLGERLFPLIQAMNPTLAGTITGLLLEMDNFRTSSYARVSRVTPVLTVDEAVAVTTSPQAKEVPESSNSATGVPTCYNGSGPMKRNFVLHAKEKYLNIENLDLYWKATTRCESIGIHNNAGTRTLEPDVPSKCPGLGNDYASPKFRYDQKEAKTHK

SEQ ID NO: 1028281 - protein, 421 aa, Homo sapiens
MGFSVIHHSQKGSRQHIIKSRDKSMDNKARYDTFSGFGNILSGKGVRDEKGSRGWDWYTFDDRRKQLKELLDKMKGMLLNDRKVFGSDDFKVTAKANEKLELRELGQTEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRQEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTDVCITALGILRD

SEQ ID NO: 1028282 - protein, 337 aa, Homo sapiens
KYRRAKDEEVSVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQSYNATACWSLYKVRNLWTASMLASAPPQEQKQMLGERLFPLIQAMNPTLAGTITGLLLEMDNFRTSSYARVSRVTPVLTVDEAVAVTTSPQAKEVPESSNSATGVPTCYNGSGPMKRNFVLHAKEKYLNIENLDLYWKATTRCESIGIHNNAGTRTLEPDVPSKCPGLGNDYASPKFRYDQKEAKTHK

SEQ ID NO: 1028283 - protein, 638 aa, Homo sapiens
ETGFSVIHHSQKGSRQHIIKSRDKSMDNKARYDTFSGFGNILSGKGVRDEKGSRGWDWYTFDDRRKQLKELLDKMKGMLLNDRKVFGSDDFKVTAKANEKLELRELGQTEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRQEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAGHCTRSGTFGLLPCWHLPLLKRQKQMLGERLFPLIQAMNPTLAGTITGLLLEMDNFRTSSYARVSRVTPVLTVDEAVAVTTSPQAKEVPESSNSATGVPTCYNGSGTHEKKLCASREEKYLNFENLDLYWKATTRCESIGIHNNAGTRTLEPDVPSKCPGLGNDYASPKFRYDQKEAKTHK

SEQ ID NO: 1028284 - protein, 546 aa, Homo sapiens
ETGFSVIHHSQKGSRQHIIKSRDKSMDNKARYDTFSGFGNILSGKGVRDEKGSRGWDWYTFDDRRKQLKELLDKMKGMLLNDRKVFGSDDFKVTAKANEKLELRELGQTEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITSMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAGHCTRSGTFGLLPCWHLPLLKRQKQMLGERLFPLIQAMNPTLAGTITGLLLEMDNFRTSSYARVSRVTPVLTVDEAVAVTTSPQAKEVPESSNSATGVPTCYNGSGTHEKKLCASREEKYLNFENLDLYWKATTRCESIGIHNNAGTRTLEPDVPSKCPGLGNDYASPKFRYDQKEAKTHK

SEQ ID NO: 1028285 - protein, 89 aa, Homo sapiens
QQRGKPLSNWITQFARRCGKSPYAPLTPEAKAGGNAMNSREVEVARESESHPCNSMPGPIHAHCPLHKKRKKKEKEGLQIIAHGKYSQQ

SEQ ID NO: 1028286 - protein, 370 aa, Homo sapiens
VPRSLGVSGGSVRVSARRVPSSSVPALLTAAPSERPAPAAAGSAILRRLAIPNAMAAVACLAGPSGASWAHVSPGCGPLWPSFPCPAFLQPGEPVPGGRALARGVGSPAATSCGGTLDGIRNIVLSNPKKRNTVVTCNAEHLSKVTFFMTLTATILKVIIISAEGPVFSSGHDLQGADRGAKAVITMPKYLRTVLQMAWPRLPAVNWLPAADIAVASDKSSFATPGVNVGLFCSTPGVALARAVPRKGAFEMLTGEPISAQGALLHGLLSKVVPRAELEETMIARKIASLEPSVVSLGKAPSTSSCPKTWGRTTSKPLWQPWPADRQEGITSSSKSRLVHQPCEWRRRVRPTAVPGHLPSWPGTLLFLAL

SEQ ID NO: 1028287 - protein, 142 aa, Homo sapiens
GSGILRSAAAQLGRQRHSEVGSGTFEVRQRHSEVGSGSECRQTVHMRCVCAAGSEVWQLCAAAVLFLWTLNHGDHVPDGDLGLGAKAAAQRGRHDLNVEFETSEEVDVSPTFDTMGLLGRTMLRGIYAYGFDKTISNPSNEP

SEQ ID NO: 1028288 - protein, 72 aa, Homo sapiens
MSVCLMSVCLMSVCLMSVCLMSVCLMSVCLMSVCLMSVCLMSVCLMSVCLVCSNCHFIFTLLDIRSSVIEVE

SEQ ID NO: 1028289 - protein, 119 aa, Homo sapiens
MSVCLMSVCLMSVCLMSVCLMSVCLMSVCLMSVCLMSVCLMSVCLMSVCLMSVCLMSVRLMSVCLMSVCLMSVCLMSVCLMSVCLIVERVPIIQKELSLSCTLRAKCNKESDGHTFNYQ

SEQ ID NO: 1028290 - protein, 122 aa, Homo sapiens
MSVCLMSVCLMSVCLMSVCLMSVCLMSVCLMSVCLMSVCLMSVCLMSVCLCKKEVDMGDFSFCSVLRKLLPWDPVDAVTLPPTLCSLKHVLCPLRVKRIKGGARCALLNRCLKAACSLRVIT

SEQ ID NO: 1028291 - protein, 77 aa, Homo sapiens
MSVCLMSVCLMSVCLMSVCLMSVCLMSVCLMSVCLMSVCLMSVCLMSVCLQCLCLLENVTITAGQRIDLAVLLADTP

SEQ ID NO: 1028292 - protein, 79 aa, Homo sapiens
DPTKTDRNCAHCTHRDARCTHVYARVRTCTHVYARVRTCTNVYAVYARVRTLCPVTIDLNSTLFGLSCRIMSSMKSSYN

SEQ ID NO: 1028293 - protein, 79 aa, Homo sapiens; identical to SEQ ID NO: 1028292

SEQ ID NO: 1028294 - protein, 102 aa, Homo sapiens
KHTLVDTCGPKECSRITIPPLSPRPQTFFPGPPAKPRSAQSEVPASPFTPSSLPAAQWVPRPDTLYLNAKVEEMEVDDFYDGIKRLYNEDNVLRKCGFCVWH

SEQ ID NO: 1028295 - protein, 102 aa, Homo sapiens; identical to SEQ ID NO: 1028294

SEQ ID NO: 1028296 - protein, 113 aa, Homo sapiens
VPCLDVLLQAVQRYAAGADVAHQRVNLRDAAIHDFFRGLAFGVSLLRRNRRALGTAGYFMGRGGHFVDRSSHLVRLVTLAFHGFFRAIGLLADLDMQRIWHPLLVRFGANTLK

SEQ ID NO: 1028297 - protein, 107 aa, Homo sapiens
MQSPAALHSLGTQAEYGLLTRHLLAFKAYLWPQTAIFVKHRSWEEAAGLHVGRDLLQALKSGEEVLQVWEGIQAAGLKYLGPLKDIISDEIHKGELVPKKPWLPQKL

SEQ ID NO: 1028298 - protein, 277 aa, Homo sapiens
IRATTCIDAKKGILQYAHEVYPDLQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEAMMRGDEDGDEVEERWEPTKKPQREPHRMGSSRQTPHKKIRGTRWFDRCALNKDDDGDVRGNDLQVDTADVTEGKCAPYFYGGMVAADGNNF

SEQ ID NO: 1028299 - protein, 67 aa, Homo sapiens
PIVQTIPRTGHEVTLEGGYDGYGSGRGFGDGYNGYGGGPGGGNFGGSPGYGGGGDLLHDEVIFCTIR

SEQ ID NO: 1028300 - protein, 449 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 1028301 - protein, 449 aa, Homo sapiens; identical to SEQ ID NO: 1028300

SEQ ID NO: 1028302 - protein, 449 aa, Homo sapiens; identical to SEQ ID NO: 1028300

SEQ ID NO: 1028303 - protein, 449 aa, Homo sapiens; identical to SEQ ID NO: 1028300

SEQ ID NO: 1028304 - protein, 472 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYGNQGAVNSSYYSSGSRASMGVNGMGGLSSMSSMSGGWGM

SEQ ID NO: 1028305 - protein, 406 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLCKYR

SEQ ID NO: 1028306 - protein, 393 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYGSQMLGGMGLCKYHFSVFFLS

SEQ ID NO: 1028307 - protein, 393 aa, Homo sapiens; identical to SEQ ID NO: 1028306

SEQ ID NO: 1028308 - protein, 429 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYGSQMLGGMGLSNQSSYGGPASQQLSGGYGGGYGGQSSMSGYDQVLQENSSDFQSNIA

SEQ ID NO: 1028309 - protein, 133 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGM

SEQ ID NO: 1028310 - protein, 133 aa, Homo sapiens; identical to SEQ ID NO: 1028309

SEQ ID NO: 1028311 - protein, 133 aa, Homo sapiens; identical to SEQ ID NO: 1028309

SEQ ID NO: 1028312 - protein, 133 aa, Homo sapiens; identical to SEQ ID NO: 1028309

SEQ ID NO: 1028313 - protein, 246 aa, Homo sapiens
MQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 1028314 - protein, 179 aa, Homo sapiens
MSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 1028315 - protein, 133 aa, Homo sapiens; identical to SEQ ID NO: 1028309

SEQ ID NO: 1028316 - protein, 114 aa, Homo sapiens
MLGTEGGEGFVVKVRGLPWSCSADEVQRFFSDCKIQNGAQGIRFIYTREGRPSGEAFVELESEDEVKLALKKDRETMGHRYVEGLIYIALVTVNKALNNRGLTPPVNIVYCLLL

SEQ ID NO: 1028317 - protein, 249 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDSRL

SEQ ID NO: 1028318 - protein, 449 aa, Homo sapiens; identical to SEQ ID NO: 1028300

SEQ ID NO: 1028319 - protein, 449 aa, Homo sapiens; identical to SEQ ID NO: 1028300

SEQ ID NO: 1028320 - protein, 449 aa, Homo sapiens; identical to SEQ ID NO: 1028300

SEQ ID NO: 1028321 - protein, 450 aa, Homo sapiens
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYDQVLQENSSDFQSNIA

SEQ ID NO: 1028322 - protein, 373 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYG

SEQ ID NO: 1028323 - protein, 373 aa, Homo sapiens; identical to SEQ ID NO: 1028322

SEQ ID NO: 1028324 - protein, 405 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYQTSPATGAQPASS

SEQ ID NO: 1028325 - protein, 443 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYEHRYVELFLNSTAGASGGAYGSQMMGGMGLSNQSSYGGPASQQLSGGYGGGYGGQSSMSGYGKACLLLYLE

SEQ ID NO: 1028326 - protein, 397 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFSGMSDHRYGDGGSTFQSTTGHCVHMRGLPYRATENDIYNFFSPLNPVRVHIEIGPDGRVTGEADVEFATHEDAVAAMSKDKANMQHRYVELFLNSTAGASGGAYGKQVMWKAVQAEERVSSKALWQKQE

SEQ ID NO: 1028327 - protein, 269 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDYNGYNDGYGFGSDRFGRDLNYCFW

SEQ ID NO: 1028328 - protein, 252 aa, Homo sapiens
MLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRWYIEIFKSSRAEVRTHYDPPRKLMAMQRPGPYDRPGAGRGYNSIGRGAGFERMRRGAYGGGYGGYDDSHGLRRR

SEQ ID NO: 1028329 - protein, 114 aa, Homo sapiens; identical to SEQ ID NO: 1028316

SEQ ID NO: 1028330 - protein, 114 aa, Homo sapiens; identical to SEQ ID NO: 1028316

SEQ ID NO: 1028331 - protein, 241 aa, Homo sapiens
MNIKGSHGKGSLLLLLVSKLLLCQSVGPLRICPGGADRCQVNLRELFVTAPSSCPTTSSKLSSEMFREFDKRNTHGLVFITKAINSCHTSSLGNPEDKEQAQQMNQKDILSLIVSILRTWNEPLYHLVTEVRGMQEAPEAILSKAVEIEEQTKRLLEGMELIVSQVHPETKEMRSTLSVRDFHPCRMADEESRLSAYYNLLHCLRRDSHKIGKYLKLLECRIITQQQLVSPHPFHLFLRSS

SEQ ID NO: 1028332 - protein, 223 aa, Homo sapiens
MNIKGSHGKGSLLLLLVSKLLLCQSVGPLRICPGGADRCQVNLRELFVTAPSSCPTTSSKLSSEMFREFDKRNTHGLVFITKAINSCHTSSLGNPEDKEQAQQMNQKDILSLIVSILRTWNEPLYHLVTEVRGMQEAPEAILSKAVEIEEQTKRLLEGMELIVSQVHPETKEMRSTLSVRDFHPCRMADEESRLSAYNLVTDYARIPLSSTISAPNCDNHDGP

SEQ ID NO: 1028333 - protein, 106 aa, Homo sapiens
MLDTPHKYRMLIAMVDVIFADVAQPDQTRIVALNAHTFLRNGGHFVISIKANCIDSTASAEAVFASEVKKMQQENMKPQEQLTLEPYERDHAVVVGVYRPPPKVKN

SEQ ID NO: 1028334 - protein, 733 aa, Homo sapiens
MGKLITRMWKLLRRRSAPKELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 1028335 - protein, 216 aa, Homo sapiens
MEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMAQQLYMTPASRRIVS

SEQ ID NO: 1028336 - protein, 87 aa, Homo sapiens
PVPRTVEEFYVDLSAPLVCVCVRRRPRPLDHIHCLLPISGDTESGWDDTAVVNDLSSTSSGTESGPQSPLTPDGKRNPKGIKKFWGK

SEQ ID NO: 1028337 - protein, 806 aa, Homo sapiens
GVTPQGASAPFSAIPSSTWNSSQSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 1028338 - protein, 540 aa, Homo sapiens
MVVGPPNRLSSTVTLLSLVQMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 1028339 - protein, 280 aa, Homo sapiens
MEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 1028340 - protein, 349 aa, Homo sapiens
MIRFRTSGSPTNRNMLFSRQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 1028341 - protein, 917 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQHQWKHMNFDAGPETMDTPTRLSSQAPPTLQLREKLKCLRPVDHSLG

SEQ ID NO: 1028342 - protein, 691 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSRLKQVPSST

SEQ ID NO: 1028343 - protein, 224 aa, Homo sapiens [sequence omitted]

SEQ ID NO: 1028344 - protein, 181 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQICNLVLRFCMLNITFFPFK

SEQ ID NO: 1028345 - protein, 280 aa, Homo sapiens; identical to SEQ ID NO: 1028339

SEQ ID NO: 1028346 - protein, 876 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 1028347 - protein, 876 aa, Homo sapiens; identical to SEQ ID NO: 1028346

SEQ ID NO: 1028348 - protein, 715 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADELYSGPTTG

SEQ ID NO: 1028349 - protein, 355 aa, Homo sapiens
YREYKMRRRVIRVVLNFLGPRILYGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 1028350 - protein, 771 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDGRMLQYLTVNDLLFLKVTSQLHHLSIKCAIHVLHVNKFNPHCLHRRPADESNLSPSEVVQWSNHRVMEWLRSVDLAEYAPNLRGSGVHGGLIVSGLSGLAHLPWCKWDIQKLIY

SEQ ID NO: 1028351 - protein, 477 aa, Homo sapiens
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLSECPALVLVASEQCPWHFQ

SEQ ID NO: 1028352 - protein, 185 aa, Homo sapiens
RPRLLKPLPPPGSSSLSCLGHVGDRRLSSPWTPWPASGAGPDSSSRVSLLPPFLSDQAQHVHALGNFYLFCQATGPADIRFVWEKNGRALETCVPVQTHALPDGRAHALSWLQDAIRESAEYRCSVLSSAGNKTSKVQVAVMRPEVTHQERWTRELSAWRAVAGEHDRMMQSWRKAWESCSKDTL

SEQ ID NO: 1028353 - protein, 124 aa, Homo sapiens
GNGGFLHCIQMDTSVNAANQVVSVGADIAFDADPKFFACLVRFESSSVPTTLPTAYDVYPLNGRHDGGYYTVKDCVTIDVLPRTPGNNVYVGFMVWSNFTATKCRGLVSLNQVIKEIICLQPLK

SEQ ID NO: 1028354 - protein, 250 aa, Homo sapiens
MSPKPRQKPKTLVGETTGTRAATGAGTSSTKASEEPKCESGGQAGTSTEATTGAGTGTGTVIGTGTGTSAGTATLLGFGFSFCSRLDPGFGPGSDISFVPVAGPGSILRAEPNAHSSSNLGPSLGFSCSLSCSLQIRFHRLSVLSCPFLGILLLYLAGKLEDFHLAGLIVRAQAPEELIFRGIAIGDSGIVQVLLIHKLISDELLHVPKECMMYPRAHPCAHNNKEENNKEQISIHEDDAKKHHEQTQLG

SEQ ID NO: 1028355 - protein, 440 aa, Homo sapiens
RGGGARAPGAGLPARWSVFRPCVCGRPASLTCSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQVSEHFFEYKKSRSGRHVVFYPTLKSLQVRLELARELGVGVSIWELGQGLDYFYDLL

SEQ ID NO: 1028356 - protein, 393 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 1028357 - protein, 440 aa, Homo sapiens; identical to SEQ ID NO: 1028355

SEQ ID NO: 1028358 - protein, 445 aa, Homo sapiens
MRSRPEPPRPHPGALASLGKTQTQPQRPHSHQAPPTTSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQVSEHFFEYKKSRSGRHVVFYPTLKSLQVRLELARELGVGVSIWELGQGLDYFYDLL

SEQ ID NO: 1028359 - protein, 502 aa, Homo sapiens
RGGGARAPGAGLPARWSVFRPCVCGRPASLTCRFPPRRQRRSQWSWNGLGSKTGCLGAEAATVSAWPASRNCRGCSSTHCLCLWLHVLGAAVLASPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQVSEHFFEYKKSRSGRHVVFYPTLKSLQVRLELARELGVGVSIWELGQGLDYFYDLL

SEQ ID NO: 1028360 - protein, 440 aa, Homo sapiens; identical to SEQ ID NO: 1028355

SEQ ID NO: 1028361 - protein, 354 aa, Homo sapiens
RGGGARAPGAGLPARWSVFRPCVCGRPASLTCSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGTSRH

SEQ ID NO: 1028362 - protein, 367 aa, Homo sapiens
RGGGARAPGAGLPARWSVFRPCVCGRPASLTCSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGAR

SEQ ID NO: 1028363 - protein, 336 aa, Homo sapiens
ISVHGARGFELIVWWPIVCLVWHILGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQVSEHFFEYKKSRSGRHVVFYPTLKSLQVRLELARELGVGVSIWELGQGLDYFYDLL

SEQ ID NO: 1028364 - protein, 362 aa, Homo sapiens [sequence omitted]

SEQ ID NO: 1028365 - protein, 133 aa, Homo sapiens
RGGGARAPGAGLPARWSVFRPCVCGRPASLTCRFPPRRQRRSQWSWNGLGSKTGCLGAEAATVSAWPALWTPRLDPTVTHLPCGHSSTSSGLPWPAALFTLPCQSQMPKKPPQRRCWRRVSFQISRCKTGVWW

SEQ ID NO: 1028366 - protein, 440 aa, Homo sapiens; identical to SEQ ID NO: 1028355

SEQ ID NO: 1028367 - protein, 440 aa, Homo sapiens; identical to SEQ ID NO: 1028355

SEQ ID NO: 1028368 - protein, 549 aa, Homo sapiens
MFQWPRSDRTWSAIVAQVLPLGDPGQGLLVRTGQSHEAATVGKGPACADSANEESPRAAATPPRSTGQPGEDTNPAPKAPQPPGTSNNQVPPHPTGLPLPYSVPPMPTADRQWASRRASGQVRPGPTGQSLDLRQGNSNPTSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQVSEHFFEYKKSRSGRHVVFYPTLKSLQVRLELARELGVGVSIWELGQGLDYFYDLL

SEQ ID NO: 1028369 - protein, 440 aa, Homo sapiens; identical to SEQ ID NO: 1028355

SEQ ID NO: 1028370 - protein, 608 aa, Homo sapiens
RGGGARAPGAGLPARWSVFRPCVCGRPASLTCSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGAMFMEPLESAFVLLANLENLRPNSSNIFSVSSLLSSRLETTNTRSIEFVPQLTNTPFTFWNSFPVRRSLALSPRLELQLTAIWLAAALLPGHAISCLSLPSSWDYRRLPPRPANLVSLVEIGISPHKPGWSRSPDLMIRPSLASQSAGITGVSHHTGLGYYFLCFLVFTGKRGLPQNPGCVHVGANIAHGGPNTTGLKPSSQPQPRQISRGPRVHATYGPAIWHPPVEDGVRAHAARGWSHNP

SEQ ID NO: 1028371 - protein, 347 aa, Homo sapiens
RGGGARAPGAGLPARWSVFRPCVCGRPASLTCSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPEVQVAKQNPPGAQLLWYGLRDLQGCP

SEQ ID NO: 1028372 - protein, 401 aa, Homo sapiens
RGGGARAPGAGLPARWSVFRPCVCGRPASLTCSPLDPEVGPYCDTPTMRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGPLSWVRACVQVLDPKSKWRSKILLGLNFYGMDYATSKDAREPVVGARYIQTLKDHRPRMVWDSQVSEHFFEYKKSRSGRHVVFYPTLKSLQVRLELARELGVGVSIWELGQGLDYFYDLL

SEQ ID NO: 1028373 - protein, 362 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 1028374 - protein, 67 aa, Homo sapiens
MGARHLDGTNPTNPDYSASLLPDWLTCTFIKSGHHVPGVYPRVGGGGGGGGEMRAPGFTPPKGVVGC

SEQ ID NO: 1028375 - protein, 111 aa, Homo sapiens
MLAQPNNVCRSPVTLPKAFITRAKQKFSTTTQQLDQDYYAVAPVLPMRETDGTNPTNPDYSASLLPDWLTCTFIKSGHHVPGVYPRVGGGGGGGGEMRAPGFTPPKGCGGV

SEQ ID NO: 1028376 - protein, 104 aa, Homo sapiens
LGPRYACRAGYFNAAALGLSNDNENAVGVRSRAPLMSINTLKPKRLPPDAPDYSASLLPDWLTCTFIKSGHHVPGVYPRVGGGGGGGGEMRAPGFTPPKGCGGV

SEQ ID NO: 1028377 - protein, 121 aa, Homo sapiens
MDRWEDYEIGGNHVQQDDGGTDDYWQQQWRTNWKTVKPDSLPMLPTEMPATTTPAGLGAVSVTSGSYPDYSASLLPDWLTCTFIKSGHHVPGVYPRVGGGGGGGGEMRAPGFTPPKGVVGC

SEQ ID NO: 1028378 - protein, 174 aa, Homo sapiens
IVDIIEKTYQTTGDQDTNIANDIKKPGLKRSAEPYLQHIIVILTVNYNGVTYAVNGGPAATIEYSVHCDHAAGTLPIWFGQYLRNIIIRKNETIKFGGKTSISCQAKGNINDRVYLIRNWVPDYSASLLPDWLTCTFIKSGHHVPGVYPRVGGGGGGGGEMRAPGFTPPKGVVG

SEQ ID NO: 1028379 - protein, 129 aa, Homo sapiens
DATFGTLAAMTAHVNALCCLPFGNDAATICTAEKMAYCAPRATWACVAVVPYVILARGNCSDCERNLDDRLAAFAVCVPTMCGQRPFVTRAVGGPRFVYPRPTPTTHNCGMGLLRTLYMHCTREWSFKC

SEQ ID NO: 1028380 - protein, 102 aa, Homo sapiens
MACCVLKLAEKSTPNKPTESESTELVIPIVPQKFQIKGLDLQQALTTFPDYSASLLPDWLTCTFIKSGHHVPGVYPRVGGGGGGGGERGPRGLPPRKGVVGC

SEQ ID NO: 1028381 - protein, 58 aa, Homo sapiens
MTTFPDYSASLLPDWLTCTFIKSGHHVPGVYPRVGGGGGGGGEMRAPGFTPPKGVVGC

SEQ ID NO: 1028382 - protein, 114 aa, Homo sapiens
LSTGKGRTSGPVVAAPLTPKETFGVPGYVSFSVSVPNVRRSYKYRIHPPPLTFNKQPPDAPDYSASLLPDWLTCTFIKSGHHVPGVYPRVGGGGGGGGEMTARGLPPRKGVVGC

SEQ ID NO: 1028383 - protein, 78 aa, Homo sapiens
MRYLGVVRFNAPGYYGAVTLCIARPDYSASLLPDWLTCTFIKSGHHVPGVYPRVGGGGGGGGEMTARGLPPRKGVVGC

SEQ ID NO: 1028384 - protein, 100 aa, Homo sapiens
MNTAAECWLNRTMFVGARSRYPKRSSRVPSKSLVRRHNNLTRITMHPDYSASLLPDWLTCTFIKSGHHVPGVYPRVGGGGGGGGEMRAPGFTPPKGVVGC

SEQ ID NO: 1028385 - protein, 67 aa, Homo sapiens
MRYNGLTLLCIARPDYSASLLPDWLTCTFIKSGHHVPGVYPRVGGGGGGGGEMRAPGFTPPKGVVGC

SEQ ID NO: 1028386 - protein, 95 aa, Homo sapiens
VIRVCVTEYDRQHYIKSTGDHGNTAKRTSTQKATPGPPELIPDYSASLLPDWLTCTFIKSGHHVPGVYPRVGGGGGGGGEMRAPGFTPPKGVVGC

SEQ ID NO: 1028387 - protein, 58 aa, Homo sapiens
MHSGPDYSASLLPDWLTCTFIKSGHHVPGVYPRVGGGGGGGGERGPRGLPPRKGVVGC

SEQ ID NO: 1028388 - protein, 65 aa, Homo sapiens
MLPVQQALTTFPDYSASLLPDWLTCTFIKSGHHVPGVYPRVGGGGGGGGEMRAPGFTPPKGVVGC

SEQ ID NO: 1028389 - protein, 133 aa, Homo sapiens
SVRRRYTVIDVRPGAGNNGVDGGGPGKPTDAENGIWELDPEVWVETKGLQGGKPMVINAVCSKYKGGGIGVLKRLCIARPDYSASLLPDWLTCTFIKSGHHVPGVYPRVGGGGGGGGEMRAPGFTPPKGVVGC

SEQ ID NO: 1028390 - protein, 100 aa, Homo sapiens
MSNITMLQDFAMELLMHYLVGKVMYHTKLKRETDQQLRKYQALTTFPDYSASLLPDWLTCTFIKSGHHVPGVYPRVGGGGGGGGEMTAPGFPPRKGVVGC

SEQ ID NO: 1028391 - protein, 109 aa, Homo sapiens
MHNSLAALTLGMPMREPCYDDYTKTSHTSKRGHGPNKMTPARTGVSATVGIMHSAPDYSASLLPDWLTCTFIKSGHHVPGVYPRVGGGGGGGGEMRAPGFTPPKGVVGC

SEQ ID NO: 1028392 - protein, 114 aa, Homo sapiens
LLYSVRRMQETNTKKASTHNANGLNKEPPTKSLSRPTREKSIYSGQKISHIGALQLCIARPDYSASLLPDWLTCTFIKSGHHVPGVYPRVGGGGGGGGEMRAPGFTPPKGCGGV

SEQ ID NO: 1028393 - protein, 106 aa, Homo sapiens
MGSVVEYGAIGGNVGPVAEFSPRCSGLEKRIEMVEPKVVIDNRCRDFHQMLYPDYSASLLPDWLTCTFIKSGHHVPGVYPRVGGGGGGGGEMTARGLPPRKGVVGC

SEQ ID NO: 1028394 - protein, 92 aa, Homo sapiens
VLTHQPTPLMRACIAKDRPIIVEAVKSNRLGLIWDDGDPDYSASLLPDWLTCTFIKSGHHVPGVYPRVGGGGGGGGEMRAPGFTPPKGCGGV

SEQ ID NO: 1028395 - protein, 96 aa, Homo sapiens
YRYVCSRRLTRKIFSAVKIGRRCKRAILDTSPEDFRTSSLGCPDYSASLLPDWLTCTFIKSGHHVPGVYPRVGGGGGGGGEMRAPGFTPPKGVVGC

SEQ ID NO: 1028396 - protein, 84 aa, Homo sapiens
MPIVAAILICYRRPLLPLPDRINTTSPPERPDYSASLLPDWLTCTFIKSGHHVPGVYPRVGGGGGGGGEMTARGLPPRKGVVGC

SEQ ID NO: 1028397 - protein, 86 aa, Homo sapiens
VIRVCVTEYDRQHYIKSTGDHGHPARKRPTRAPDYSASLLPDWLTCTFIKSGHHVPGVYPRVGGGGGGGGEMTARGLPPRKGVVGC

SEQ ID NO: 1028398 - protein, 99 aa, Homo sapiens
AVLTVAVNMYLMAGARWIHGLHSHSLPTPNFTTHGKASAYCITTTPDYSASLLPDWLTCTFIKSGHHVPGVYPRVGGGGGGGGEMRAPGFTPPKGVVGC

SEQ ID NO: 1028399 - protein, 69 aa, Homo sapiens
MIESNNWKQQLKPTFPDYSASLLPDWLTCTFIKSGHHVPGVYPRVGGGGGGGGEMRAPGFTPPKGVVGC

SEQ ID NO: 1028400 - protein, 93 aa, Homo sapiens
MWTSRRFVIGRWGLVIYDGLTFLWLARFHTRLKIPTRCRPDYSASLLPDWLTCTFIKSGHHVPGVYPRVGGGGGGGGEMRAPGFTPPKGVVGC

SEQ ID NO: 1028401 - protein, 134 aa, Homo sapiens
MNTAAECWLNRTMFVGARSRYPKRSSRVPSKSLVRRHNNLTRITMQSRRFCQCVKPQTLTYAAWTPRLVDTPEDGTNPTNPDYSASLLPDWLTCTFIKSGHHVPGVYPRVGGGGGGGGEMRAPGFTPPKGCGGV

SEQ ID NO: 1028402 - protein, 67 aa, Homo sapiens; identical to SEQ ID NO: 1028374

SEQ ID NO: 1028403 - protein, 135 aa, Homo sapiens
MIPTVPVYERLVHQTRYLPLTFVTAYTVAAFCGVHLHLLHRVSNALYAKVSVSTFAALLTSRGLRCCTALWPLVCLTSGSYPDYSASLLPDWLTCTFIKSGHHVPGVYPRVGGGGGGGGEMRAPGFTPPKGVVGC

SEQ ID NO: 1028404 - protein, 121 aa, Homo sapiens
MTKTAEEKDEEYNRGGAGGSRAGGKSNDKLLTLQMEVSKKGKRPELSKIKRTAGYHYALRRLQTSGSYPDYSASLLPDWLTCTFIKSGHHVPGVYPRVGGGGGGGGEMRAPGFTPPKGVVG

SEQ ID NO: 1028405 - protein, 155 aa, Homo sapiens
RSELSLGGWSIHGAHVWEIGYNILDVLRLLVLTVYSISERKKTRAKSINMFAYRRALWLCYGYCYLPKGRLLHMLIWQLSVEFARKNRKYSASRKQAAHYIPDYSASLLPDWLTCTFIKSGHHVPGVYPRVGGGGGGGGEMRAPGFTPPKGVVGC

SEQ ID NO: 1028406 - protein, 148 aa, Homo sapiens
MGHCYLPWATLSDKYYWIKNIGFRLELLLEPMKEEVGSERVAGAIADKPAYVYRMKGRLPVHVVLNQVHNLASLILEINDKHAVERLTLLCIARPDYSASLLPDWLTCTFIKSGHHVPGVYPRVGGGGGGGGERGPRGLPPRKGVVGC

SEQ ID NO: 1028407 - protein, 72 aa, Homo sapiens
YSVRQNRLVIRCNGVVICGHLSGNTTGGHGDEHEDTHEQKDDDYNEHYKLVPLNIRQVPGYICYFNIMPVVY

SEQ ID NO: 1028408 - protein, 68 aa, Homo sapiens
MLLAGRKDGTNPTNPDYSASLLPDWLTCTFIKSGHHVPGVYPRVGGGGGGGGEMTARGLPPRKGVVGC

SEQ ID NO: 1028409 - protein, 82 aa, Homo sapiens
MVASHQSPPDATRAPPDAHQTTTTPPDAPDYSASLLPDWLTCTFIKSGHHVPGVYPRVGGGGGGGGEMTARGLPPRKGVVGC

SEQ ID NO: 1028410 - protein, 159 aa, Homo sapiens
VSSGEPFYWEPKLIPRITMNPSRVVQEEKIETEEENPGVKKDENEGGDRGKGEHKGDRERQQKLKKGFKLQIGHMPNCRSTKGSTEDIPIEIDTGEAEKQAAHYIPDYSASLLPDWLTCTFIKSGHHVPGVYPRVGGGGGGGGEMRAPGFTPPKGVVGC

SEQ ID NO: 1028411 - protein, 132 aa, Homo sapiens
DAWHSMIHVARARPLDTEFNVCALGHVLGADKNAAIHCVRRRSYQKEHNKYTHACIHDMKGKVDDYSPASRRRLCIARPDYSASLLPDWLTCTFIKSGHHVPGVYPRVGGGGGGGGEMRAPGFTPPKGCGGV

SEQ ID NO: 1028412 - protein, 116 aa, Homo sapiens
MRWHYTLVRFVTRKWETVRRTSNGLAELSAYISYINFSANQTWRYASVGLAKNHLVLHLFDTNPDYSASLLPDWLTCTFIKSGHHVPGVYPRVGGGGGGGGEMRAPGFTPPKGVVG

SEQ ID NO: 1028413 - protein, 67 aa, Homo sapiens
MSSVAMLKVLTRAPDYSASLLPDWLTCTFIKSGHHVPGVYPRVGGGGGGGGEMRAPGFTPPKGVVGC

SEQ ID NO: 1028414 - protein, 89 aa, Homo sapiens
TPKKQTVCCEVSAGGPIWRRLNDKIVPIRLCTGRGPDYSASLLPDWLTCTFIKSGHHVPGVYPRVGGGGGGGGEMRAPGFTPPKGVVGC

SEQ ID NO: 1028415 - protein, 91 aa, Homo sapiens
VSSCVVTYGPCVALSICRVYKIAIRILAFEDGTNPTNPDYSASLLPDWLTCTFIKSGHHVPGVYPRVGGGGGGGGEMRAPGFTPPKGVVGC

SEQ ID NO: 1028416 - protein, 105 aa, Homo sapiens
VITSFIELYTSCLEFWLVLNTDTGERVRERKTKANALDLSTRETSAGATRAPDYSASLLPDWLTCTFIKSGHHVPGVYPRVGGGGGGGGEMRAPGFTPPKGCGGV

SEQ ID NO: 1028417 - protein, 87 aa, Homo sapiens
ESLERYGKCALLTCCVTLLDHQSPPEHQSPPDAPDYSASLLPDWLTCTFIKSGHHVPGVYPRVGGGGGGGGEMTARGLPPRKGVVGC

SEQ ID NO: 1028418 - protein, 71 aa, Homo sapiens
MMMQAMGRLTTRAHEIRPDYSASLLPDWLTCTFIKSGHHVPGVYPRVGGGGGGGGEMRAPGFTPPKGVVGC

SEQ ID NO: 1028419 - protein, 104 aa, Homo sapiens
MWTSPVTLPKAFITRAKQKFSTTTQQLDQDYYAVAPVLPMRETDGTNPTNPDYSASLLPDWLTCTFIKSGHHVPGVYPRVGGGGGGGGEMRAPGFTPPKGCGGV

SEQ ID NO: 1028420 - protein, 104 aa, Homo sapiens
MLAQPNNVCRSPVTLPKAFITRAKQKFSTTTQQLDQDYYAVAPVLPMRETPDYSASLLPDWLTCTFIKSGHHVPGVYPRVGGGGGGGGEMRAPGFTPAKGCGGV

SEQ ID NO: 1028421 - protein, 158 aa, Homo sapiens
LSVMLRHDACICPVIMQYYYTIFQMIKQDKQDDENTMDKLKKKNKGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDEQ

SEQ ID NO: 1028422 - protein, 475 aa, Homo sapiens
MPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 1028423 - protein, 475 aa, Homo sapiens; identical to SEQ ID NO: 1028422

SEQ ID NO: 1028424 - protein, 374 aa, Homo sapiens
MVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 1028425 - protein, 724 aa, Homo sapiens
RFPGGLVGVADLGGCGAEVGGCGTRAESRGGRDLAELEGAGERGSGGPRGPAERASGVSAAAPGERAGDGAPSRAVAGASAMFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPPCRVAALLSRKRLPDLDVQGSLSSRGYGWACPAVMAPCFLLLGAGSRTLPTIHAVAPRAEPLLVLWQP

SEQ ID NO: 1028426 - protein, 374 aa, Homo sapiens; identical to SEQ ID NO: 1028424

SEQ ID NO: 1028427 - protein, 661 aa, Homo sapiens
RFPGGLVGVADLGGCGAEVGGCGTRAESRGGRDLAELEGAGERGSGGPRGPAERASGVSAAAPGERAGDGAPSRAVAGASAMFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 1028428 - protein, 221 aa, Homo sapiens
KFLIHIESVVIHQEDMSIGRNLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 1028429 - protein, 578 aa, Homo sapiens
RFPGGLVGVADLGGCGAEVGGCGTRAESRGGRDLAELEGAGERGSGGPRGPAERASGVSAAAPGERAGDGAPSRAVAGASAMFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLALGNLPPPVPGHLGCGENGLRLLGGLRRFPPPPGRRPGRGPN

SEQ ID NO: 1028430 - protein, 157 aa, Homo sapiens [sequence omitted]

SEQ ID NO: 1028431 - protein, 262 aa, Homo sapiens
RFPGGLVGVADLGGCGAEVGGCGTRAESRGGRDLAELEGAGERGSGGPRGPAERASGVSAAAPGERAGDGAPSRAVAGASAMFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVGPYPNPDGVDRPPTLMPLVSGSSGGRLAPGASCAACPSAVHGELCADFSHMSRVETEP

SEQ ID NO: 1028432 - protein, 322 aa, Homo sapiens
KLRLGTRPGWCFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLALGNLPPPVPGHLGCGENGLRLLGGLRRFPPPPGRRPGRGPN

SEQ ID NO: 1028433 - protein, 405 aa, Homo sapiens
KLRLGTRPGWCFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 1028434 - protein, 661 aa, Homo sapiens; identical to SEQ ID NO: 1028427

SEQ ID NO: 1028435 - protein, 355 aa, Homo sapiens
GVSLGAWLAWRTWAVRGGSGRLRDARGVARRAGPGRAGGRRGAGLGRSPRPGGAGFWGVCGGAGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 1028436 - protein, 635 aa, Homo sapiens
RFPGGLVGVADLGGCGAEVGGCGTRAESRGGRDLAELEGAGERGSGGPRGPAERASGVSAAAPGERAGDGAPSRAVAGASAMFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITMQWLPGQSLSLYFGSHRKRAHFLFSCVRKKPPVFQGERAGPEGGGGASSLAQLGESEAHCLLPWGCGDGPVTSWRPCGGSSLACAMVGVLGPVRREPPHPAAQVAGVALFLLAQQCCLQRP

SEQ ID NO: 1028437 - protein, 620 aa, Homo sapiens
RFPGGLVGVADLGGCGAEVGGCGTRAESRGGRDLAELEGAGERGSGGPRGPAERASGVSAAAPGERAGDGAPSRAVAGASAMFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTLQPRLQVWPCFSLPSSAAFSGRDGASWTHGEIFSYVNKRQFGKREKK

SEQ ID NO: 1028438 - protein, 299 aa, Homo sapiens
RFPGGLVGVADLGGCGAEVGGCGTRAESRGGRDLAELEGAGERGSGGPRGPAERASGVSAAAPGERAGDGAPSRAVAGASAMFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEKAEPGVQDENMKADKERDH

SEQ ID NO: 1028439 - protein, 475 aa, Homo sapiens; identical to SEQ ID NO: 1028422

SEQ ID NO: 1028440 - protein, 475 aa, Homo sapiens; identical to SEQ ID NO: 1028422

SEQ ID NO: 1028441 - protein, 200 aa, Homo sapiens
MLAVIIGSEMCHIHRASVRGRKLFHSKCISWSYRNRGYDARIHRKVIVNASVFSTKLIVYSSDVCGSWNAPRKRIAVNAFIMMMLAYSAMKNMAKGPAAYSTLKPDTSSDSPSVRSNGARLVSARVEINHIMARGQDVKIIQMCSCVVIRVDRVYDPFIRSTDSRMIASVTSYEIVWATARRAPMSAYFELDAHPDHRIE

SEQ ID NO: 1028442 - protein, 176 aa, Homo sapiens
VGRAHLEPELGIRIEKKTQQRVIVNASVFSTKLIVYSSDVCGSWNAPRKRIAVNAFIMMMLAYSAMKNMAKGPAAYSTLKPDTSSDSPSVRSNGARLVSARVEINHIMARGQDVKIIQMCSCVVIRVDRVYDPFIRSTDSRMIASVTSYEIVWATARRAPMSAYFELDAHPDHRIE

SEQ ID NO: 1028443 - protein, 152 aa, Homo sapiens
GQDVKIIQMCSCVVIQGGSWNAPRKRIAVNAFIMMMLAYSAMKNMAKGPAAYSTLKPDTSSDSPSVRSNGARLVSARVEINHIMARGQDVKIIQMCSCVVIRVDRVYDPFIRSTDSRMIASVTSYEIVWATARRAPMSAYFELDAHPDHRIE

SEQ ID NO: 1028444 - protein, 102 aa, Homo sapiens
VRRPLSCENDLDFCPLHGAMFRLVSARVEINHIMARGQDVKIIQMCSCVVIRVDRVYDPFIRSTDSRMIASVTSYEIVWATARRAPMSAYFELDAHPDHRIE

SEQ ID NO: 1028445 - protein, 124 aa, Homo sapiens
MNHQQTGGVGGLSYVGGYVSAAALLSLIAVLCLKETRDNDLNKVPDRPPSRASPLPHLTEFQHENAVKCGSGLARKGATRLQLYYNSLGSTGRFSPSRFNRLIPRQRHAHPTLTIHTSPYLENK

SEQ ID NO: 1028446 - protein, 110 aa, Homo sapiens
HADGGVEKREPCYTVGGIEIGATTVENSMVIPQKTRIDLGIPLLGIYPEKTMTQKDACTRMFTEALFSIAKTWKQPKCPSAEEWIKKIWYPSATRRWVFCKVERGSVGFC

SEQ ID NO: 1028447 - protein, 102 aa, Homo sapiens
GAGLPHHHHDEGLLLLLSNGARLVSARVEINHIMARGQDVKIIQMCSCVVIRVDRVYDPFIRSTDSRMIASVTSYEIVWATARRAPMSAYFELDAHPDHRIE

SEQ ID NO: 1028448 - protein, 116 aa, Homo sapiens
MDHHSTYAALSLVTLSVSLHVLHSAPDVQDCPECTPQENPFFSQPGAPKLQGMGCCFSRAYPTPLRSKKTMLVQKNVTSESTCCVAKSYNRVTVMGGFKVENHTACHCSTCYYHKS

SEQ ID NO: 1028449 - protein, 175 aa, Homo sapiens
ITREETPLKTEGKKIPFFRVSNSSNPGPCEPHFRCKIEAPMRKEGRRQWRIQPYKENIYCEANLSGAHCECGCFSCIVTHIRVSSDVQDCPECTPQENPFFSQPGAPKLQGMGCCFSRAYPTPLRSKKTMLVQKNVTSESTCCVAKSYNRVTVMGGFKVENHTACHCSTCYYHKS

SEQ ID NO: 1028450 - protein, 134 aa, Homo sapiens
MKACSGTAWLARHPEDRTTASISRGFILVINAPLGFLARLHNPPEIGPKLLLKWGHLLLNRKAYACYYRPRRVPPALRRPLLTHPKPLAQAPGRQPGLSRSRASFFAPHFRVPAFLREPLGLTWIRDNPCPLPP

SEQ ID NO: 1028451 - protein, 136 aa, Homo sapiens
MADHLGIPLGLGFDSCSLHCSQQSKKVWAEEKASDQQWQWQLWRTAKPSGLNGEASKSQEMVHFGEPRSRQKLQTMFMTADETMEPAEMWTLIVGCNSNPIILQRHNSCHHNHYREVVQLPHTMRGRVFHYKFFSA

SEQ ID NO: 1028452 - protein, 223 aa, Homo sapiens
RGAALQEVSSLVTPFLAVHPIPGAKTVPGSQRQLRQNRCYQQTKTHSTPVGRSHTTHGSESDGHSHGSQEGGANTTSGPIRTPQIPEWLIILASLLALALILAVCIAVNSRRRCGQKKKLVINSWQWQLWRTAKPSGLNGEASKSQEMVHFGEPRSRQKLQTMFMTADETMEPAEMWTLIVGCNSNPIILQRHNSCHHNHYREVVQLPHTMRGRVFHYKFFSA

SEQ ID NO: 1028453 - protein, 290 aa, Homo sapiens
TGTGPLAMTTQQSNSQSFWTAQEGLEEDRDHPTTGTRTSSHRNDVTGGRRDPDRSEGSTTVLEGYTSHYPHAKESRTFIPVTSAKTGSCGVTAVTVGDSHSNVNVPYQQTKTHSTPVGRSHTTHGSESDGHSHGSQEGGANTTSGPIRTPQIPEWLIILASLLALALILAVCIAVNSRRRCGQKKKLVINSWQWQLWRTAKPSGLNGEASKSQEMVHFGEPRSRQKLQTMFMTADETMEPAEMWTLIVGCNSNPIILQRHNSCHHNHYREVVQLPHTMRGRVFHYKFFSA

SEQ ID NO: 1028454 - protein, 32 aa, Homo sapiens
CYLHKRFFFFIVTKPHFSIDILISIFDWHVVL

SEQ ID NO: 1028455 - protein, 428 aa, Homo sapiens
MERTTCYPPLLLYEMRTEIPRRVPANDQAQYDLLMKRTCPTHVTRGIDLYRICLRYPVTSLRAFPAQKKKQKKERTKKKQNKGGGDPHIYLIFYTVSQLIKKSTHTSQQVRTRRKHNSKQRRREEENEQMSDSKRRRGRKRRTPETTREHGGFDLIKENTRSGARSRRGEREGGQRTEGRGQKRRGAAARQEKNAQGVASRRPAEQRLRRREEEDEERKDRHNSKDRKQKAAEEESDRRAREKDTNARDDCTTTQNARGKEKREDGSVPTSKQRKAKAKREKRQRPSGDHDRKDNREPNRTRTERERNKRSKKIPTQQPVKRREQTQQSSRNTCSDEQQKAAARCEQTNKRKKKIRKPQSIPSRLQVRHARQHNDGPHTARNSAAEYYRDSTRTESKTTASTRTSRTKETGRPYRDKTTSNRKHQTRT

SEQ ID NO: 1028456 - protein, 76 aa, Homo sapiens
EILHQSFQRVNRKPYYSGHTLQIDDVLRMELFMPLINDMMWRQRAQLKKLVESLPQKPRESIIKLMEKIAPSSLCN

SEQ ID NO: 1028457 - protein, 46 aa, Homo sapiens
MSLDCRTIKVTYRLHSQRGTYRLGPEPLRRFWSGFLSQQGEQIVSI

SEQ ID NO: 1028458 - protein, 68 aa, Homo sapiens
DTGEAWLGSPQEADNHGRRRRGSRHVSGHGGAGETERVKQEVLHASKQPDPMSAHSLSRDQQGGRQPP

SEQ ID NO: 1028459 - protein, 304 aa, Homo sapiens
FTGIPAGPVTDLRLRGREGGGAGGARRGRALGTRPGSRLRGFSWPRQRGLCGGGGGAASRTSSFPERPAAPVPREAGGRRTRPNLDVDYRAARDGKRLIKPRPAGPSHSPPRRPAAPNAGHTQPPWSDGPTPDDPGHGQTRDDPGRGAPPAGGRAAGLGSPWRGHACDMASAVFEGTSLVNMFVRGCWVNGIRRLIVSRRGDEEEFFEIRTEWSDRSVLYLHRSLADLGRLWQRLRDAFPEDRSELAQGPLRQGAGPGTREGRGAEAALKCTKEAGRLQPRLRLLLSARPGQGTLGPRARRRGV

SEQ ID NO: 1028460 - protein, 497 aa, Homo sapiens
FTGIPAGPVTDLRLRGREGGGAGGARRGRALGTRPGSRLRGFSWPRQRGLCGGGGGAASRTSSFPERPAAPVPREAGGRRTRPNLDVDYRAARDGKRLIKPRPAGPSHSPPRRPAAPNAGHTQPPCDVDCVPVPLWLTPVPLGHDPVWLTPVACVAAASLSCAVCCVLCCVVLVCDASCAGVCIAVLYIGLLAGCLMGALSASCEQCSVRCAAGVERDPAVLIVSRRGDEEEFFEIRTEWSDRSVLYLHRSLADLGRLWQRLRDAFPEDRSELAQGPLRQGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQHLGVDPTERYGRMAVSSLRSWRPRDRPRQAYVHQPVHITTWSPFENDFGRGPFYKAARPQWLLPVLVCPCAGPGPAVAPWDPSSGPWPGGVSWDTALAGAEPRWRRAGGPGGARGVASC

SEQ ID NO: 1028461 - protein, 470 aa, Homo sapiens
FTGIPAGPVTDLRLRGREGGGAGGARRGRALGTRPGSRLRGFSWPRQRGLCGGGGGAASRTSSFPERPAAPVPREAGGRRTRPNLDVDYRAARDGKRLIKPRPAGPSHSPPRRPAAPNAGHTQPPWSDGPTPDDPGHGQTRDDPGRGAPPAGGRAAGLGSPWRGHACDMASAVFEGTSLVNMFVRGCWVNGIRRLIVSRRGDEEEFFEIRTEWSDRSVLYLHRSLADLGRLWQRLRDAFPEDRSELAQGPLRQGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQHLGVDPTERYGRMAVSSLRSWRPRDRPRQAYVHQPVHITTWSPFENDFGRGPFYKAARPQWLLPVLVCPCAGPGPAVAPWDPSSGPWPGGVSWDTALAGAEPRWRRAGGPGGARGVASC

SEQ ID NO: 1028462 - protein, 262 aa, Homo sapiens
FTGIPAGPVTDLRLRGREGGGAGGARRGRALGTRPGSRLRGFSWPRQRGLCGGGGGAASRTSSFPERPAAPVPREAGGRRTRPNLDVDYRAARDGKRLIKPRPAGPSHSPPRRPAAPNAGHTQPPWSDGPTPDDPGHGQTRDDPGRGAPPAGGRAAGLGSPWRGHACDMASAVFEGTSLVNMFVRGCWVNGIRRLIVSRRGDEEEFFEIRTEWSDRSVLYLHRSLADLGRLWQRLRDAFPEDRSELAQGPLRQDLFNELLEN

SEQ ID NO: 1028463 - protein, 169 aa, Homo sapiens
RQYSYGLSGWSGSVAGAESGPQRALSSPTAAAGLVTITPREEPQLPQPAPVTITATMSSEAETQQPPAPPRRPRPQRRRHQAPALRAAAQGAVARAASHRRRLPGGDKKVIATTGLGNSKTGSSVRNGYGFINRNDTKERCICTTRLAIKKNNPRKYLRQCTEMERLWS

SEQ ID NO: 1028464 - protein, 109 aa, Homo sapiens
TAVLLRFKWLVWIGSGSGERTPESPEQPHRRRRPSYHHTPGGAAAAAAGPSHHHRNHEQRGRDPAAARAPPAPPTSAPPTPSAGTTGSGRRVAGGYWGLRGKKYEKLEN

SEQ ID NO: 1028465 - protein, 159 aa, Homo sapiens
TAVLLRFKWLVWMVAGAESGPQRALSSPTAAAGLVTITPREEPQLPQPAPVTITATMSSEAETQQPPAPPRRPRPQRRRHQAPALRASHRRRLPGGDKKVIATTGLGNSKTGSSVRNGYGFINRNDTKERCICTTRLAIKKNNPRKYLRQCTEMERLWS

SEQ ID NO: 1028466 - protein, 61 aa, Homo sapiens
QIKMSARLDSIVVCAGGNPATFSHPPTLSYLRSTARHGVRMIGVSAGPFIPAQAGLLDSYR

SEQ ID NO: 1028467 - protein, 82 aa, Homo sapiens
MHALNDVTAVVEHTADVLSVHSAGEMRVAVVTPISTGSADPQKLISNEVLGPGLQKLFSAHFRRMNGPSPAQAWLRCHAIDR

SEQ ID NO: 1028468 - protein, 182 aa, Homo sapiens
MHALNDVTAVVEHTADVLSVHSAGEMRVAVVTPISTGSADPQKLISNEVLGPGHAWVLSGLGSSILRSSVASKFWKVVLNLRFPSKDFLSEQILLVEEQDHRDGAQPSVVPDALEEVQSLLQAVWSDCPPEKTMIVNCCLATTKMNGKSHRMKHWIHLRRYIALATHVKHVEIDFVHLELGP

SEQ ID NO: 1028469 - protein, 285 aa, Homo sapiens
PHLHQPTQIPRSDSARPRSPRLPGASREPAGLAHSDSEQSLSFDPDAPAPFPGTPAPAGQLLPTCLAMDDPCPMLAAATLQLGLQCQLHSCCLPTLHHPGCMEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEADLGEAKKQLQDEMLRRVDAENQAEDPVKEELDFQNDHLQ

SEQ ID NO: 1028470 - protein, 228 aa, Homo sapiens
CHFLHGGGSGVASLERAESSSTEPAKAIKPIDRKSVHQICSGPVVLSLSTAVKKIVENSLDAGATNIDLKLKDYGMDLIEVSGNGCGVEEENFEGLTLKHHTSKIQEFADLTRVETFGFRGKALSSLCALSDVTISTCHVSAKVGTRLVFDHDGKIIQKTPYPHPRGTTVSVKQLFSTLPVRHKEFQRNIKKKRACFPFAFCRDCQFLEGSPAMLPVQPAKLTPRSTP

SEQ ID NO: 1028471 - protein, 197 aa, Homo sapiens
CHFLHGGGSGVASLERAESSSTEPAKAIKPIDRKSAHQICSGPVVLSLSTAVKKMVENSLDAGATNIDLKLKDYGMDLIEVSGNGCGVEEENFEGFNDVTISTCHVSAKVGTRLVFDHDGKIIQKTPYPHPRGTTVSVKQLFSTLPVRHKEFQRNIKKKRACFPFAFCRDCQFLEGSPAMLPVQPAKLVSQLNFFTS

SEQ ID NO: 1028472 - protein, 385 aa, Homo sapiens
CHFLHGGGSGVASLERAESSSTEPAKAIKPIDRKSAHQICSGPVVLSLSTAVKKMVENSLDAGATNIDLKLKDYGMDLIEVSGNGCGVEEENFEGFNDVTISTCHVSAKVGTRLVFDHDGKIIQKTPYPHPRGTTVSVKQLFSTLPVRHKEFQRNIKKKRACFPFAFCRDCQFLEGSPAMLPVQPAKLTEPAKAIKPIDRKSVHQICSGPVVLSLSTAVKKIVGNSLDAGATNIDLKLKDYGMDLIEVSGNGCGVEEENFEGLSLSALKHHTSKIREFADLTRVETFGFRGKALSSLCALSDVTISTCHVSAKVGTRLVFDHDGKIIQKTPYPHPRGTTVSVKQLFSTLPVRHKEFQRNIKKNLLRPSNLLIGSQSIRFALGRWY

SEQ ID NO: 1028473 - protein, 137 aa, Homo sapiens
CHFLHGGGSGVASLERAESSSTEPAKAIKPIDRKSVHQICSGPVVLSLSTAVKKIVENSLDAGATNIDLKLKDYGMDLIEVSGNGCGVEEENFEGLMMSPFLPATYRRRLGLDWCLITMGKSSRKPPTPTPEGPQSA

SEQ ID NO: 1028474 - protein, 136 aa, Homo sapiens
MWGRRRKLRRLNDVTISTCHVSAKVGTRLVFDHDGKIIQKTPYPHPRGTTVSVKQLFSTLPVRHKEFQRNIKKKRACFPFAFCRDCQFLEGSPAMLPVQPAKLTPRSTPPHPCSLEDNVITVFSSVKNGPGSSPPS

SEQ ID NO: 1028475 - protein, 217 aa, Homo sapiens
CHFLHGGGSGVASLERAESSSTEPAKAIKPIDRKSVHQICSGPVVLSLSTAVKKIVENSLDAGATNIDLKLKDYGMDLIEVSGNGCGVEEENFEGLTLKHHTSKIQEFADLTRVETFGFRGKALSSLCALSDVTISTCHVSAKVGTRLVFDHDGKIIQKTPYPHPRGTTVSVKQLFSTLPVRHKEFQRNIKKPHPCSLEDNVITVFSSVKNGPGSSR

SEQ ID NO: 1028476 - protein, 136 aa, Homo sapiens; identical to SEQ ID NO: 1028474

SEQ ID NO: 1028477 - protein, 136 aa, Homo sapiens; identical to SEQ ID NO: 1028474

SEQ ID NO: 1028478 - protein, 136 aa, Homo sapiens; identical to SEQ ID NO: 1028474

SEQ ID NO: 1028479 - protein, 35 aa, Homo sapiens
MILTTATPAWGDRRKSCLNNKKPDTGLPFKTHHNK

SEQ ID NO: 1028480 - protein, 144 aa, Homo sapiens
MWGRRRKLRRLKALKHHTSKIQEFADLTRVETFGFRGKALSSLCALSDVTISTCHVSAKVGTRLVFDHDGKIIQKTPYPHPRGTTVSVKQLFSTLPVRHKEFQRNIKKKRACFPFAFCRDCQFLEGSPAMLPVQPAKLTPRSTP

SEQ ID NO: 1028481 - protein, 46 aa, Homo sapiens
MLMSIYQSSLARFSELYCLGKKRYGRGMSPVAHAVFQDLGDNPGKI

SEQ ID NO: 1028482 - protein, 136 aa, Homo sapiens; identical to SEQ ID NO: 1028474

SEQ ID NO: 1028483 - protein, 136 aa, Homo sapiens; identical to SEQ ID NO: 1028474

SEQ ID NO: 1028484 - protein, 136 aa, Homo sapiens; identical to SEQ ID NO: 1028474

SEQ ID NO: 1028485 - protein, 136 aa, Homo sapiens; identical to SEQ ID NO: 1028474

SEQ ID NO: 1028486 - protein, 136 aa, Homo sapiens; identical to SEQ ID NO: 1028474

SEQ ID NO: 1028487 - protein, 217 aa, Homo sapiens; identical to SEQ ID NO: 1028475

SEQ ID NO: 1028488 - protein, 273 aa, Homo sapiens
CHFLHGGGSGVASLERAESSSTEPAKAIKPIDRKSAHQICSGPVVLSLSTAVKKMVENSLDAGATNIDLKLKDYGMDLIEVSGNGCGVEEENFEGFNDVTISTCHVSAKVGTRLVFDHDGKIIQKTPYPHPRGTTVSVKQLFSTLPVRHKEFQRNIKKKRACFPFAFCRDCQFLEGSPAMLPVQPAKLTEPAKAIKPIDRKSVHQICSGPVVLSLSTAVKKIVGNSLDAGATNIDLKLKDYGMDLIEVSGNGCGVEEENFEGLISFSSETSHI

SEQ ID NO: 1028489 - protein, 128 aa, Homo sapiens
MQHLLLHSLCLSCSTMARNVPASPSPSAVIVSFLRAPQPCFLYSLQNCPETQEPAKAIKPIDRKSVHQICSGPVVLSLSTAVKKIVENSLDAGATNIDLKLKDYGMDLIEVSGNGCGVEEENFEGLKL

SEQ ID NO: 1028490 - protein, 65 aa, Homo sapiens
GDGAYVWGQLRPHRMGRRLDGGAKFRQLNNFNSEATFQFHTTCDSSGLKFDVHLKNRMVFLFCLL

SEQ ID NO: 1028491 - protein, 224 aa, Homo sapiens
MASLPGSDGGIQYGWQVALLPLTGIRYSSCSVKTQRISPLYGFLPQNPFREPSELSGEMLFASCCCLHTHVLVPVEVKRPRGVSLTNHHFYDESKPFTCLDGSATIPFDQVNDDYCDCKDGSDEPGTAACPNGSFHCTNTGYKPLYIPSTGSTMVYCDCCDGTDEYKQLCIICDAHHAESKGRNVRERPCSRWPMVTRDGYRLTMILIEGLARRHGRRSRKMLI

SEQ ID NO: 1028492 - protein, 166 aa, Homo sapiens
MVPAAQEAEAGEWLNLGVRGCSEPGVAPMACQASDRVRLVSKKQKNQTTNKTTESGGTIRHYDTARHRNNNHAQGTQGTHKTISSHTCDTTKSYNDRRDPAAQRHNAGRALPSTETHAPAGVTHAEDWWTQPPKRDRRTTEEEEYTNRRKHTGESRERLRTTPTHP

SEQ ID NO: 1028493 - protein, 278 aa, Homo sapiens
PETVRYYPVQAKALLSSTVSSYHDEERTRDSTSGSILNLNLDRSKAEMDLKELSESVQEQIHPVFLSSLPSARSRSRFQLNSGQAPYRVAKHNLGINDTSRTHVYTADESTAIRRHLSTLSIAERIAERILTLQCMSHAHAPPAPRAQHRPQHATHRQAPRSTHAPPQRSPNSLTLPPPTPPQPPTQPTLITTPPQRMPTHHLTQDTRKTLGTQHTATGFHTQRPHNGNTQRANETTPWATYSTPSQQCEHHTCHPTHPPLNSPPFNRHTGHPIIISP

SEQ ID NO: 1028494 - protein, 277 aa, Homo sapiens
VLSLSGSFGSASVATAPALPPPPTAARASVAAASLSRSLDRTSSQMQRRDDPAARMSRSSGRSGSMDPSGAHPSVRQTPVSAACLLPHLCPWGVLEWGSLLGCCPGPRPATQPATAAACPRPRGPRQRTVGWASAGPRCCPPRPQPRSRWMPENKYLPELMAEKDSLDPSFTHAMQLLTAEIEKIQKGDSKKDDEENYLDLFSHKNMKLKGASADTLSNQYPKFNFCGEDSWTTREYNPRLRERLGKISVWARLIEDNQRKCQGDPFPLMSFLLALV

SEQ ID NO: 1028495 - protein, 195 aa, Homo sapiens
AEEDFAIVLLKLDEVKGFNSKDSPKLFQINRQNKSLPPVFMKLVFTLAKIIEALKMYSISNNKAMTRGAIAAMLSTILYSRRFFPYYVYNIIGGLDEEGKGAVYSFDPVGSYQKDSFKAGGSASAMLKPLLTNQVGFKNIQNVEHVPLSLDRAMRLVKDVFISAAKKNVYPGDALRICIVTKEGIREETVSLRKD

SEQ ID NO: 1028496 - protein, 102 aa, Homo sapiens
MMLNGIPLGPFLLGTPWRDMHETIRPLVNRSINGSRGWRDFGAFDQMLKRLHIRLNEQGLIDLETWMIDSTAVRATRASSGAGKKGDLKNRKTTRSGAAGVA

SEQ ID NO: 1028497 - protein, 406 aa, Homo sapiens
MGVTARRRVVWDYSTPGNQPRSLQEGLKGEQVKLTEALKNSQGLEKPLQVASATVSAGLWLLYPKPLFEDTPYILEPGEYPISEAWGTSDPSVGSLKPMRLAVVYEAPGFQGRSWEVSRDIYNLQQPEDSQSPHLASVGSLRVLGGCWVGYEKEGFRGHQYLLEEGEYPDWSHWGGYDELLTSLRVIRTDFGDPAVVLFEAMDFEGHGVEVSKALPDVELVQHGPNTQAIHVLSGVWVAYQEVGFSGEQYVLEKGVYRNCEDWGAGNSTLASLQPVLQVGEHDLHFVSKIQLFSRPDFLGDHFSFEDDQAALPPPSDLSPAGSTAAAGSCLMRRTSRVTSTILSEGRVPQSHGMGCLASTVLGSLQKVSCTFQSPPIFLVLARVARGGRAIELAGSCGACKRGSHL

SEQ ID NO: 1028498 - protein, 300 aa, Homo sapiens
MGVTARRRVVWDYSTPGNQPRSLQEGLKGEQVKLTEALKNSQGLEKPLQVASATVSAGLWLLYPKPLFEDTPYILEPGEYPISEAWGTSDPSVGSLKPMRLGCPSVEKPGEPRAVVYEAPGFQGRSWEVSRDIYNLQQPEDSQSPHLASVGSLRVLGGCWVGYEKEGFRGHQYLLEEGEYPDWSHWGGYDELLTSLRVIRTDFGDPAVVLFEAMDFEGHGVEVSKALPDVELVQHGPNTQAIHVLSGVSGSTICTSSQRFSFSPAPTFWATTSLSKMTRPLCRLLPTSVLPGPRRQLDPV

SEQ ID NO: 1028499 - protein, 67 aa, Homo sapiens
MSRSLHWRWHLGKSGCVIQGCGASDFRSRSNWKWFQEKPLSFSHTRPYRKPTQVGEMSILRRNERFR

SEQ ID NO: 1028500 - protein, 41 aa, Homo sapiens
MRRGFMLNCPSDVYLRSVTGVVYALQGPVQLQHSTLRILLN

SEQ ID NO: 1028501 - protein, 110 aa, Homo sapiens
ILLMLIPPYAHPVLMLIPPYARSLLMLIPPYAHPSLCSSLLMLIPPYAHPSLCSSLLMLIPPYAHPSLCSSLLMLIPPYAHYQPSLTDHTFAKPFHPNNVIGDRNRNLAQ

SEQ ID NO: 1028502 - protein, 227 aa, Homo sapiens
DFLPPKKIKDPDASKPEDWDERAKIDDPTDSKPEDWDKPEHIPDPDAKKPEDWDEEMDGEWEPPVIQNPEYKGEWKPRQIDNPEWTQGTSGPPRNWTNPGVFFRFQRILLANVVYILCVWRGLLRLCGVSMCGKPSYDIFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 1028503 - protein, 80 aa, Homo sapiens
DFLPPKKIKDPDASKPEDWDERAKIDDPTDSKPEDWDKPEHIPDPDAKKPEDWDEEMDGEWEPPVIQNPVIQWCIGIVLR

SEQ ID NO: 1028504 - protein, 89 aa, Homo sapiens
LVPLKEGLRHLKLEVTPQITPEGNIILDVDINKDSRGETTACRHRDQHQAREDPGTGRERRHGGDRRQSFEQVDRDEVSQTILRDPLSH

SEQ ID NO: 1028505 - protein, 90 aa, Homo sapiens
EEEDIGGGGPGYGNYRSGGYGGGYDNYGGGNYGSGNYNDFGNYNQQPSNYGPMKSGDFGGSRNMGGPYGGGNYGPGGSGGSGGYGGRSRY

SEQ ID NO: 1028506 - protein, 149 aa, Homo sapiens
MESRGKSASSPKPDTKVPQVTTEAKVPPAADGKAPLTKPSKKEAPAEKQQPPAAPTTAPAKKTSAKADPALLNNHSNLKPAPTVPSSPDATPEPKGPGDGAEEDEAASGGPGGRGSWSCENFNPLLVAGGVAVAAIALILGVAFLVRKK

SEQ ID NO: 1028507 - protein, 204 aa, Homo sapiens
GHSRALLRVRSRRHPAEERAAPGRPEDAPIECPGATNCPEPLWCSHLPVPYAPPTMESRGKSASSPKPDTKVPQVTTEAKVPPAADGKAPLTKPSKKEAPAEKQQPPAAPTTAPAKKTSAKADPALLNNHSNLKPAPTVPSSPDATPEPKGPGDGAEEDEAASGGPGGRGPWSCENFNPLLVAGGVAVAAIALILGVAFLVRKK

SEQ ID NO: 1028508 - protein, 204 aa, Homo sapiens; identical to SEQ ID NO: 1028507

SEQ ID NO: 1028509 - protein, 141 aa, Homo sapiens
MDPVCGPPTPGGWVILGPQGWSECRWGCRDGLGLGPALVGTLKGAVAPLAPFLLFAYPPGVCLGECSGTDLGWALTSAEPQCHLPTPPKPSWVGRRSPEACVWRGCCPRVAFPSLCSRGAPTPAGRQGCRGPLTAVPALPR

SEQ ID NO: 1028510 - protein, 149 aa, Homo sapiens; identical to SEQ ID NO: 1028506

SEQ ID NO: 1028511 - protein, 75 aa, Homo sapiens
QLYPVRPIWGLIGAAGPPAYTRATATRDPSYICNLHHSSQQHQILNPLSKARDRTRNLMVPSQIRYPLSHDRNSC

SEQ ID NO: 1028512 - protein, 67 aa, Homo sapiens
QLYPVRPIWGLIGAAGPPAYTRATATRDPSYICNLHHSSQQHQILNPLSKARDRTRNLMVPSQIHFC

SEQ ID NO: 1028513 - protein, 67 aa, Homo sapiens
QLYPVRPIWGLIGAAGLPAYTRATATRDPSYICNLHHSSQQHQILNPLSKARDRTCNLMVPSRIINH

SEQ ID NO: 1028514 - protein, 79 aa, Homo sapiens
QLYPVRPIWGLIGAAGLPAYTRATATRDPSYICNLHHSSQQHQILNPLSKARDRTCNLMVPSQIHFCCATMGTPISAIF

SEQ ID NO: 1028515 - protein, 624 aa, Homo sapiens
LKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLYVILFFFMAL

SEQ ID NO: 1028516 - protein, 857 aa, Homo sapiens
LKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFLYISYKYSQTRVSTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYNDGKNEKSWNDRCTTRFTFELPNHRSRFTSKVSATDMSTIPPSASLNLPPVTMSGTYIMEEHDSHSDQVWSIDELASKQGYYLQGTLSAMCGSNVVPWNIILQLIF

SEQ ID NO: 1028517 - protein, 666 aa, Homo sapiens
LKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQTVVKCSIAKSQALYSAQRGLKTNNAAVFKVGAISINIPQHPATLHSMMVRSSHQLSKQISDLIRQPSTA

SEQ ID NO: 1028518 - protein, 840 aa, Homo sapiens
LKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYNDGKNEKSWNDRCTTRFTFELPNHRSRFTSKVSATDMSTIPPSASLNLPPVTMSGTYIMEEHDSHSDQVWSIDELASKQGYYLQGTLSAMCGSNVVPWNIILQLIF

SEQ ID NO: 1028519 - protein, 332 aa, Homo sapiens
MVNRTHLEADIGGLTMESELKRIHGSFTLKEKMKDVLHQKMTETCATAHIGGVNIVLLEGITPNIQTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYNDGKNEKSWNDRCTTRFTFELPNHRSRFTSKVSATDMSTIPPSASLNLPPVTMSGTYIMEEHDSHSDQVWSIDELASKQGYYLQGTLSAMCGSNVVPWNIILQLIFYNHLVLVQKVFMKEVTEVCQKVS

SEQ ID NO: 1028520 - protein, 155 aa, Homo sapiens
SDGRYSDRERNITLIQAFGLTEQTVFLALPGLGHDPVVHAIDSGVGHERVLGQVVEQHVEAEDVVGHQQLSRRSGSLGCQARAQGVSLLVHGLLELQTHHAGVDHQGQSDQDHVMAGDAQCNRYTAMAQCPEDQQEEVIGFYWRGPVHLRSALGP

SEQ ID NO: 1028521 - protein, 40 aa, Homo sapiens
MCSEEIEKEGVPVVAQWLTNPTRNHEVAGSVHPVIQYEGI

SEQ ID NO: 1028522 - protein, 73 aa, Homo sapiens
TQKREEVENIAAVHNEVSTVELRGVDSEERGCGKERERGVPVVAQWLTNPTRNHEVAGSVPALAQWVNDPALP

SEQ ID NO: 1028523 - protein, 69 aa, Homo sapiens
LRIPPAYILVKKSELIFCSTSLPLLSGLRIRRCRELWCRLQTRLGSRAARIPRCCGSGVGRWLQLRFDP

SEQ ID NO: 1028524 - protein, 111 aa, Homo sapiens
GHKRALDHLYSDICSGDGGLTSYIPFWRNSQSAVHFTEQSGLNNMKNFLGTLHNRAMTTFTDAFSVLHQDCPRAPAHIPSLKRARLRETDRPDIPILYDWAVNRRARLNPR

SEQ ID NO: 1028525 - protein, 223 aa, Homo sapiens
MTRIVADDVRDVALRLLCPWPPMSGVVHFVGTQAGLVHTPRPVPPPAVFLLCDVCRTVDIVPPGRDMVATSYRGPRKRVVRQISEYHPPLLGAGAQCIEAGLQEAAMGEDWGVGNKGRVQRGTSLSHWSMVARKAFTRVEGAHKECTPKGMWNSRAFSPCVGPEVLATGLRGPWGATSFEVASIMQLATGAGVAKSYGNPAGPGLFTRTLAVAPHVARIGIVF

SEQ ID NO: 1028526 - protein, 255 aa, Homo sapiens
MTSGMWLSDCCARGPRCPEWCIFSLARVMFAREALLRGVGGRIRAALLRVLQHHAAGQRVAVGLAMSNGGYSWAGVLVGCFKTPSTHGHSVAPAKGRGPPTIPRQTIVDDVAKKMRITMTLKLLGPGPSCMVVLSTVMFSKVTEGTGGAPPLQEWGKRPLASYRMWDFEHGGIVWARPLAPVRRKSGMGGNCHGERLRDQETRTYAGVEQPVPGKGYVVRAPEAKIGNARPVNNGTETRTGRSQRTSQKNGLACG

SEQ ID NO: 1028527 - protein, 229 aa, Homo sapiens
MTSGMWLSDCCARGPRCPEWCILCRHTGRPRAHTQALPPPAVFLLCDVCRTVDIVPPGRDMVATQHKGQKESGAPDLRVYTLLFPVWARGGLQVHVKGGHTGKAWQGEKRGGGAHATGLGVCEVDTLTFPHVGPCGMCPGKPLREWRVRIRSARLEDVEQPAFSPCVGPEVLATGLRGPWGATSFEVASIMQLATGAGVAKSYGNPAGPGLFTRTLAVAPHVARIGIVF

SEQ ID NO: 1028528 - protein, 199 aa, Homo sapiens
SGPRCRVLTSGIFETKFQVDKVNFHMFDVGGQRDERRKWIQGFNDVTAIIFVVASSSYNMVIREDNQTNRLQEALNLFKSRLEQQMVRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 1028529 - protein, 199 aa, Homo sapiens; identical to SEQ ID NO: 1028528

SEQ ID NO: 1028530 - protein, 199 aa, Homo sapiens; identical to SEQ ID NO: 1028528

SEQ ID NO: 1028531 - protein, 192 aa, Homo sapiens
RPEPHNRSQRWLHPHVYVKHGEILRTEPVATGNWYMQLIPQQLLTPLVPLFRNSRLVQFHFTKDLETLKSLCRIMDNGFAGCVHFSYKASCEIRVLMLLYSSEKKIFIGLIPHDQGNFVNGIRRVIAQPASQGLQTEPGAGATDNAEDVGGNGYPAAGPLPEITDEAPARDCAWEPVARQPPLHPCPPVTRF

SEQ ID NO: 1028532 - protein, 148 aa, Homo sapiens
HGQWLLSPSVRWRRLDFGVSDTSHQIASRIMDNGFAGCVHFSYKASCEIRVLMLLYSSEKKIFIGLIPHDQGNFVNGIRRVIAQPASQGLQTEPGAGATDNAEDVGGNGYPAAGPLPEITDEAPARDCAWEPVARQPPLHPCPPVTRF

SEQ ID NO: 1028533 - protein, 227 aa, Homo sapiens
TPAQFDADELLPCKGLGTDEDTLIEILASRTNKEIRDINRVYREELKRLAKDITSDTSGDFRNALLSLAKGDRSEDFGVNENLADSDARALYEAGERRKGTVNFNTYPYQKSTTSQSVSEITKYSKHNMIQSSVPGRHLKIPHSYREVRHKQTSFLGTEAPSSHEEVLELPHKALIDYRFPGPEIDMNDINSILIRTMYWYLPFAKPSLDETKGDYEKILVALCGGN

SEQ ID NO: 1028534 - protein, 88 aa, Homo sapiens
RPGCLVFPYALFLTLTTKLTNTNISDAQEIETALNLSCPPSILVLIGPSNPYGILYNNKTEVNGSLPFLQINWHQLVLILRVTRFGGL

SEQ ID NO: 1028535 - protein, 109 aa, Homo sapiens
MPVPALWLKSSLRIFKPSGWISWPSPSDYPCLHEGVLESLPEQRGGGGELGGVGIVMREVGGVLAIWAKQQLWTCLKATLAWSGMASDFQTPEPGQFLLKVCKIKLCAG

SEQ ID NO: 1028536 - protein, 251 aa, Homo sapiens
LRLPALGLAGGQCASCDPADHECVDRYMGEGSSVYHHVNSQPSGLVTVTLLISRLDVPLQDESWGRPRMVGAPLPPSCAGGGPALIPWQGFVSSCSGLRGESGAGPRLCLSTFQALTLCKTVCRSHLRRCCKTSLPGGVRHSESKTEIPAEGNAACVNPCVVQVSRRNGDELLRWKICPLQTPPFSKGDIIYSHSARFQDIGRLSTACAGGLYPCRWTPLGLARATVPGSTGHFRRASGPPFTLFPGAGTT

SEQ ID NO: 1028537 - protein, 69 aa, Homo sapiens
MRLGSGAQRLPGSHLALGSPEVLVRVWAASGSVGTAAWLVVSRIGKPTPNVFSFTQKADFGLKKPCVHW

SEQ ID NO: 1028538 - protein, 69 aa, Homo sapiens; identical to SEQ ID NO: 1028537

SEQ ID NO: 1028539 - protein, 123 aa, Homo sapiens
MLMGVMERAAKRTRRLQGATAMVRRQPIVQDIKDNLKEAIVTIVASMSDLVPPVELCNPENQFRVDYILSVMNVPDSDVPPEFYEHAKALWEDEWSACLLRRSNEYQLMTVPSTSWKIDLSSR

SEQ ID NO: 1028540 - protein, 70 aa, Homo sapiens
VTQDPVELDSSLAEAGSGRSRKRQKQEAAEAGSGRSRKRQKQEAGEGAEKKGKDQKPTMPQAEAEAGRAH

SEQ ID NO: 1028541 - protein, 131 aa, Homo sapiens
YWQKQEAGRSLPASAHPRLSNNRKRQKQEAAEAGSRQKQEAGRSRKQQKQEAAEAGSGRSRKRQKQEAAEAGSGRSRKRQKQEAAEAGSSRSRKRQKQEAAEAGSRRRGRKEGEGSKAHHAPGRSRSGPSS

SEQ ID NO: 1028542 - protein, 125 aa, Homo sapiens
SPDPATFDAYKKNDRKIQKRSRKRQKQEAGRSRKQAEAGSSRSRKRQKQEAAEAGSGRSRKQQKQEAAEAGSGRSRKRQKQEAAEAGSGRSRKRQKQEAGEGAEKKGKDQKPTMPQAEAEAGRAH

SEQ ID NO: 1028543 - protein, 116 aa, Homo sapiens
YWQKQEAGRSLPASAHPRLSNNRKRQKQEAAEAGSRQKQEAGRSRKQQKQEAAEAGSGRSRKRQKQEAAEAGSGRSRKQHFFWKKLVFYWKGKKEVVRTEAEAGAPLQKQKRKQKD

SEQ ID NO: 1028544 - protein, 77 aa, Homo sapiens
TLVIPLTKTLRMQEATPRPWPHLEGRSRKRQKQEAAEAGSGRSRKRQKQEAGEGAEKKGKDQKPTMPQAEAEAGRAH

SEQ ID NO: 1028545 - protein, 134 aa, Homo sapiens
PYKTCTEEGKRRGRRRRKEEKGEGDEEGRSRKRQKQEAGRSRKQAEAGSSRSRKRQKQEAAEAGSGRSRKQQKQEAAEAGSGRSRKRQKQEAAEAGSGRSRKRQKQEAGEGAEKKGKDQKPTMPQAEAEAGRAH

SEQ ID NO: 1028546 - protein, 50 aa, Homo sapiens
MSQRDTLVHLFAGGCGGTVGAILDMSTGSCKHHGWSQCHPIMASGPFHWL

SEQ ID NO: 1028547 - protein, 155 aa, Homo sapiens
MRISANNLQGPVDVSYTSGTGIDPEDIYKTALAKYKAKYPRFSKADIIELAEMELNKQLKDVDIFTHVEKQSGKKVNVNWGTIKKPLWEEIEVDYRPKRFGSSKKRTSAAPAEIQSPSKELNALGEYKDFKDLPEPEKIKNSIAFTPSEDGRLLA

SEQ ID NO: 1028548 - protein, 269 aa, Homo sapiens
LSCTVVERKYTGNASALLMLTEQDKMEDVQAKLLPETLERGRDSMEFREIAGARYLPKFYISRDYNQNDILLQLGIEEAFTSKADLSGITGARNLAVSQVVHKAVLDVFEEGTEASAATAVIITLLSALVETGTIERLNRPFLKIIVPTDTLNIFFMSKVTNPSKPRACHQAVELSVGTWNASWMPESLCTDWPLCTPVAMACVALTAYPCKVTEIACVVLTCTVHMDSSVCSVLRLLTRIYLDGLHNRMSIDHSRLDLYLCSLSHYVD

SEQ ID NO: 1028549 - protein, 141 aa, Homo sapiens
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERAMSCGKVEVTGGVTRDSLGP

SEQ ID NO: 1028550 - protein, 78 aa, Homo sapiens
GGPVRPLSGPVPMEALGKLKQFDAYPKTLEDFRVKTCGGATVTIVSGLLMLLLFLSELQYYLTTEVHPELYVGQVAGR

SEQ ID NO: 1028551 - protein, 145 aa, Homo sapiens
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERAMSLGNSPHGDACLTLISLDPDRL

SEQ ID NO: 1028552 - protein, 259 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFGGLSIKKDEEVLKKNCPHIVVGTPGRILALGSEIRASASIHIKPLHFGLKCDTRCLEQVDHGVGDVPGKFFGMTTKEKQVMMVQGYLGAKRESVQSAEIHADPWRYFVVAQ

SEQ ID NO: 1028553 - protein, 147 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAV

SEQ ID NO: 1028554 - protein, 313 aa, Homo sapiens
MALRICVTYTPALPIGLCTRCCLCLEQSPSWCHCLRGVSFLTFHLHQSVPLGDRDSLLMFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARAVGVAHLGEAFRVGVEQAISSCPEEVHGRHGLSMEIMWARMDVALRSPGRGLLAGAGALCVTLAESSCPDYERGRRACLTLHRHPTPHCSTWGLPLRVAGSWLTVVTVEALGGWRMGVRRTGQVGPTMHPPPVSGASPLLLHHLLLLLLIIILTC

SEQ ID NO: 1028555 - protein, 86 aa, Homo sapiens
ASCEGSFQVSTGEPGVMLASFILHASDDPVALSARPPGPLAHISDSDVLPHRMLQSDGGDRTAVPDGGGNAQSCGSHLAAVKHQWE

SEQ ID NO: 1028556 - protein, 313 aa, Homo sapiens
MALRICVTYTPALPIGLCTRCCLCLEQSPSWCHCLRGVSFLTFHLHQSVPLGDRDSLLMFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARAVGVAHLGEAFRVGVEQAISSCPEEVHGRHGLSMEIMWARMDVALRSPGRGLLAGAGALCMTLAESSCPDYERGRRACLTLHRHPTPHCSTWGLPLRVAGSWLTVVTVEALGGWRMGVRRTGQVGPTMHPPPVSGASPLLLHHLLLLLLIIILTC

SEQ ID NO: 1028557 - protein, 75 aa, Homo sapiens
VSVLSPGKWNFPPPRDVMMIDVTSSAQCLYRWRQCPELWQPPCSREAPVGMTVKRTTEMPAPGPTAAAPASRLRV

SEQ ID NO: 1028558 - protein, 255 aa, Homo sapiens [sequence omitted]

SEQ ID NO: 1028559 - protein, 394 aa, Homo sapiens
NAARGHGDPGTERRPLIFPMVKGVSAFPGWITDGSIFLLLRVHSGAGKFISDPKSSHVMPRLTPLTTSPGTWTASGSFPRLMALRICVTYTPALPIGLCTRCCLCLEQSPSWCHCLRGVSFLTFHLHQSVPLGDRDSLLMFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARAVGVAHLGEAFRVGVEQAISSCPEEVHGRHGLSMEIMWARMDVALRSPGRGLLAGAGALCMTLAESSCPDYERGRRACLTLHRHPTPHCSTWGLPLRVAGSWLTVVTVEALGGWRMGVRRTGQVGPTMHPPPVSGASPLLLHHLLLLLLIIILTC

SEQ ID NO: 1028560 - protein, 255 aa, Homo sapiens
MFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARAVGVAHLGEAFRVGVEQAISSCPEEVHGRHGLSMEIMWAQMDVALRSPGRGLLAGAGALCMTLAESSCPDYERGRRACLTLHRHPTPHCSTWGLPLRVAGSWLTVVTVEALGRWRMGVRRTGQVGPTMHPPPVSGASPLLLHHLLLLLLIIILTC

SEQ ID NO: 1028561 - protein, 313 aa, Homo sapiens; identical to SEQ ID NO: 1028554

SEQ ID NO: 1028562 - protein, 160 aa, Homo sapiens
MAGPGWLLGMARHGPWGLVLGAQLSARHSHHPRGLVILPCPRPGSKRAAPRPAGIRSGQVAGLGMSEDPRVVRGKDSSWGLAPRVEEGDCVCVCVCVGARARTSVLYGPGSLKALGAGCACFCVLFLWAWRLLEPRHPPNPRTKQTKSIKELSDCKKKKK

SEQ ID NO: 1028563 - protein, 196 aa, Homo sapiens
AGRCHSREHEGPNPGAPHGKDSDDDDDVAVTVDRDRFMDEFFEQVEEIRGFIDKIAENVEEVKREAQVAILGIPQPRMRRRRRSWKNSCPDIKKTANKVRSKVKEHRSRSIGGKEGRGWNRLLPGWNLEGSGKTQALHGWSRKFVEVMSEYNATQSEFNREGACAKARFQKAAWRIHRREPRNQLREAGDGALLGR

SEQ ID NO: 1028564 - protein, 109 aa, Homo sapiens
MKVLILKGERIEDECGQDPYIRELGLYETGSHYGSLVYQFEFMSLPSFSEKLSHPEDYGGLIYTSPRAVEAAELCLEQNNKTEVWERVSEKKNGHAKSVYVVGKCYCYL

SEQ ID NO: 1028565 - protein, 251 aa, Homo sapiens
MAPYSLLVTRLQKALGVRQYHVASVLCQRAKVAMSHFEPNEYIHYDLLEKNINIVRKRLNRPLTLSEKIVYGHLDDPASQEIELRQVVPAVCGRDRVAMPGCDWTRVAMLQFISQRACPSVAVPSTIHCDHLIECPGMGAMKDLRRSQGHQPGKFIISWQLQVPNMAWASGSLDLEIIHQIILENYAYPGVLLIGTDSHTTQVVAALGASALEVGGAECCGCQWLGSPARLKCPTVIGVKADGLSLREVLT

SEQ ID NO: 1028566 - protein, 247 aa, Homo sapiens
GAAETAPRASEQGVGRSEDSMYTAIPQSGLSIPRLRCTDPGLHVWRVEKLKPVPVAQENQAVFFSGDSYLDAAQVAPEEVSHLHLWIGQQSSRDEQGGRVPVLAVHLNTLRGESGHVQHLQVRALESDLFMSYFPRGPQYQEGGVESAFIKTSTGAQLPSRKLYLGEGEKKKIRGHRAGHVNVGQSSRPGDCFIVDLGQNIFAMVLVEKSTILERNSEARELARVIRDSERQVKAQVDDVPDGEGAW

SEQ ID NO: 1028567 - protein, 114 aa, Homo sapiens
LPDEGCLTQEFPSLGGKDIETKSAFEPENTCSSLLAFLLRYDDLFSTAIIFYHLLTLPHLHYLLLAPLEEEPIFLGSPLLNTCLRELHHDGRRTVTSGQVSADESRRSPAPAMG

SEQ ID NO: 1028568 - protein, 123 aa, Homo sapiens
MSQIKPGAPGPKTSIETNIEVLYDANVKVAGKSKHLMWRHMGFWKSASGGMHVTGGTFFREWCSARHLAHKGPNSPGLRDSGRPARSLIRYYGTFLRGTRPPFTSKVSSALGWFTGKAFGQTD

SEQ ID NO: 1028569 - protein, 32 aa, Homo sapiens
MQVYASAESGASCSISLLPLLSSVIIPPSPSV

SEQ ID NO: 1028570 - protein, 32 aa, Homo sapiens; identical to SEQ ID NO: 1028569

SEQ ID NO: 1028571 - protein, 100 aa, Homo sapiens
TNMVVPATWDSFQHCAPLPVQNPVDATDHLLWTLDLHKVDGLHEAVAGLVSTLGCSRQRLCLWGMILAPFRRWIGVAMQGDCRGRRKRTPRHVLLTQCAL

SEQ ID NO: 1028572 - protein, 412 aa, Homo sapiens
FGVKSRWPRHSARADKVVGVGVLVEERLDGAHVLVGEVAAYHTLVGNRVVGFADAGQQHQAHVMELEGAKNHQVSRLFTLAALGVDVGHAGGFLLGAVEVDLEHVGIGPQLEVGHLAQGRQDVHVRRSLGVHVAHVATAKPAEVARAHLRTVGVGVRPRRIGRRQVVRFVTYVGRRFLKQLGGDSIFLRLQRERVGAIRRVGVAATAFTDQLALDRPGLAGGAKDFFRIVEKRLQLFVADAEVLDGHVLGNEVLPVALFVMAAHAQLNRVDAKMHARPVQPRTTNAIARQERAQLTIGQGDVIHAVANGHRFFGDVLEQLLTHAVGQFVDDLGIVTQVVCTPPESPYTTRPGDGARAIPCLRGAFITSSNFISKITLVDADNRQSEGGDDRGYERVSDPSGGRGGPGEPRNG

SEQ ID NO: 1028573 - protein, 96 aa, Homo sapiens
IAIVSTTVETKDPEKEIRPALELLEPIEQKFVSISDLLVPKDLGTESQIFISRTYDANHSFETTCDDIKNIYKRMTGSEFDFEEMKRKKNDIYGED

SEQ ID NO: 1028574 - protein, 195 aa, Homo sapiens
SVTHTSNMFYSVVFIIFHVFHCNSLIYTVLQCRFPTNVFFSVTHSSNMFYSVVFIIFHVSHCNSLIYTVLQIPFPTNVFFSVTHSSNMFYSVVFIIFHVFHCNSLIYTVLQIPFPTNVFFIVTHTSKMFYSVVFIIFHVSHCNSLIYTVLQCQFPTNVFFSVTRSSNMFYSVVFIIFHVFHCNSVDAAAHLVVVG

SEQ ID NO: 1028575 - protein, 644 aa, Homo sapiens
LLRGSPCFGVLQLAAGFIPLPCLWSLLLLLGCSTPVRIRRGGTSLSAAANSRRVRLRTPGAESRVPPPPRGTHSPRSPGPRVLPPATLPHVVPPFPITWHFKNAGKMAVAAAAAAAGPAGAGGGRAQRSGLLEVLVRDRWHKVLVNLSEDALVLSSEEGAAAYNGIGTATNGSFCRGAGAGHPGAGGAQPPDSPAGVRTAFTDLPEQVPESISNQKRGVKVLKQELGGLGISIKGGKENKMPILISKIFKGLAADQTQALYVGDAILSVNGADLRDATHDEAVQALKRAGKEVLLEVKYMREATPYVKKGSPVSEIGWETPPPESPRLGGSTSDPPSSQSFSFHRDRKSIPLKMCYVTRSMALADPENRQLEIHSPDAKHTVILRSKDSATAQAWFSAIHSNVNDLLTRVIAEVREQLGKTGIAGSREIRHLGWLAEKVPGESKKQWKPALVVLTEKDLLIYDSMPRRKEAWFSPVHTYPLLATRLVHSGPGKGSPQAGVDLSFATRTGTRQGIETHLFRAETSRDLSHWTRSIVQGCHNSAELIAEISTACTYKNQECRLTIHYENGFSITTEPQEGAFPKTIIQSPYEKLKMSSDDGIRMLYLDFGGKDGEIQLDLHSCPKPIVFIIHSFLSAKITRLGLVA

SEQ ID NO: 1028576 - protein, 488 aa, Homo sapiens
LLRGSPCFGVLQLAAGFIPLPCLWSLLLLLGCSTPVRIRRGGTSLSAAANSRRVRLRTPGAESRVPPPPRGTHSPRSPGPRVLPPATLPHVVPPFPITWHFKNAGKMAVAAAAAAAGPAGAGGGRAQRSGLLEVLVRDRWHKVLVNLSEDALVLSSEEGAAAYNGIGTATNGSFCRGAGAGHPGAGGAQPPDSPAGVRTAFTDLPEQVPESISNQKRGVKVLKQELGGLGISIKGGKENKMPILISKIFKGLAADQTQALYVGDAILSVNGADLRDATHDEAVQALKRAGKEVLLEVKYMREATPYVKKGSPVSEIGWETPPPESPRLGGSTSDPPSSQSFSFHRDRKSIPLKMCYVTRSMALADPENRQLEIHSPDAKHTVILRSKDSATAQAWFSAIHSNVNDLLTRVIAEVREQLGKTGIAGSREIRHLGWLAEKVPGESKKQWKPALVVLTEKDLLIYDSMPRRKEAWFSPVHTYPLLATSPHP

SEQ ID NO: 1028577 - protein, 644 aa, Homo sapiens; identical to SEQ ID NO: 1028575

SEQ ID NO: 1028578 - protein, 696 aa, Homo sapiens
LLRGSPCFGVLQLAAGFIPLPCLWSLLLLLGCSTPVRIRRGGTSLSAAANSRRVRLRTPGAESRVPPPPRGTHSPRSPGPRVLPPATLPHVVPPFPITWHFKNAGKMAVAAAAAAAGPAGAGGGRAQRSGLLEVLVRDRWHKVLVNLSEDALVLSSEEGAAAYNGIGTATNGSFCRGAGAGHPGAGGAQPPDSPAGVRTAFTDLPEQVPESISNQKRGVKVLKQELGGLGISIKGGKENKMPILISKIFKGLAADQTQALYVGDAILSVNGADLRDATHDEAVQALKRAGKEVLLEVKYMREATPYVKKGSPVSEIGWETPPPESPRLGGSTSDPPSSQSFSFHRDRKSIPLKMCYVTRSMALADPENSHRNHRFEELKATIMTMWFEFSWIPRSCCKPARLHPPDYVSSVFSPESLGGERQLEIHSPDAKHTVILRSKDSATAQAWFSAIHSNVNDLLTRVIAEVREQLGKTGIAGSREIRHLGWLAEKVPGESKKQWKPALVVLTEKDLLIYDSMPRRKEAWFSPVHTYPLLATRLVHSGPGKGSPQAGVDLSFATRTGTRQGIETHLFRAETSRDLSHWTRSIVQGCHNSAELIAEISTACTYKNQECRLTIHYENGFSITTEPQEGAFPKTIIQSPYEKLKMSSDDGIRMLYLDFGGKDGEIQLDLHSCPKPIVFIIHSFLSAKITRLGLVA

SEQ ID NO: 1028579 - protein, 540 aa, Homo sapiens
LLRGSPCFGVLQLAAGFIPLPCLWSLLLLLGCSTPVRIRRGGTSLSAAANSRRVRLRTPGAESRVPPPPRGTHSPRSPGPRVLPPATLPHVVPPFPITWHFKNAGKMAVAAAAAAAGPAGAGGGRAQRSGLLEVLVRDRWHKVLVNLSEDALVLSSEEGAAAYNGIGTATNGSFCRGAGAGHPGAGGAQPPDSPAGVRTAFTDLPEQVPESISNQKRGVKVLKQELGGLGISIKGGKENKMPILISKIFKGLAADQTQALYVGDAILSVNGADLRDATHDEAVQALKRAGKEVLLEVKYMREATPYVKKGSPVSEIGWETPPPESPRLGGSTSDPPSSQSFSFHRDRKSIPLKMCYVTRSMALADPENSHRNHRFEELKATIMTMWFEFSWIPRSCCKPARLHPPDYVSSVFSPESLGGERQLEIHSPDAKHTVILRSKDSATAQAWFSAIHSNVNDLLTRVIAEVREQLGKTGIAGSREIRHLGWLAEKVPGESKKQWKPALVVLTEKDLLIYDSMPRRKEAWFSPVHTYPLLATSPHP

SEQ ID NO: 1028580 - protein, 610 aa, Homo sapiens
MGYVGISGLLWEGCSTPVRIRRGGTSLSAAANSRRVRLRTPGAESRVPPPPRGTHSPRSPGPRVLPPATLPHVVPPFPITWHFKNAGKGGRAQRSGLLEVLVRDRWHKVLVNLSEDALVLSSEEGAAAYNGIGTATNGSFCRGAGAGHPGAGGAQPPDSPAGVRTAFTDLPEQVPESISNQKRGVKVLKQELGGLGISIKGGKENKMPILISKIFKGLAADQTQALYVGDAILSVNGADLRDATHDEAVQALKRAGKEVLLEVKYMREATPYVKKGSPVSEIGWETPPPESPRLGGSTSDPPSSQSFSFHRDRKSIPLKMCYVTRSMALADPENRQLEIHSPDAKHTVILRSKDSATAQAWFSAIHSNVNDLLTRVIAEVREQLGKTGIAGSREIRHLGWLAEKVPGESKKQWKPALVVLTEKDLLIYDSMPRRKEAWFSPVHTYPLLATRLVHSGPGKGSPQAGVDLSFATRTGTRQGIETHLFRAETSRDLSHWTRSIVQGCHNSAELIAEISTACTYKNQECRLTIHYENGFSITTEPQEGAFPKTIIQSPYEKLKMSSDDGIRMLYLDFGGKDGEIQLDLHSCPKPIVFIIHSFLSAKITRLGLVA

SEQ ID NO: 1028581 - protein, 685 aa, Homo sapiens
LLRGSPCFGVLQLAAGFIPLPCLWSLLLLLGCSTPVRIRRGGTSLSAAANSRRVRLRTPGAESRVPPPPRGTHSPRSPGPRVLPPATLPHVVPPFPITWHFKNAGKMAVAAAAAAAGPAGAGGGRAQRSGLLEVLVRDRWHKVLVNLSEDALVLSSEEGAAAYNGIGTATNGSFCRGAGAGHPGAGGAQPPDSPAGVRTAFTDLPEQVPESISNQKRGVKVLKQELGGLGISIKGGKENKMPILISKIFKGLAADQTQALYVGDAILSVNGADLRDATHDEAVQALKRAGKEVLLEVKYMREATPYVKKGSPVSEIGWETPPPESPRLGGSTSDPPSSQSFSFHRDRKSIPLKMCYVTRSMALADPENRQLEIHSPDAKHTVILRSKDSATAQAWFSAIHSNVNDLLTRVIAEVREQLGKTGIAGSREIRHLGWLAEKVPGESKKQWKPALVVLTEKDLLIYDSMPRRKEAWFSPVHTYPLLATSRWSLTVSPSLECSGMILAHCNLRLPGQAVFCLSLPSSWNYRLVHSGPGKGSPQAGVDLSFATRTGTRQGIETHLFRAETSRDLSHWTRSIVQGCHNSAELIAEISTACTYKNQECRLTIHYENGFSITTEPQEGAFPKTIIQSPYEKLKMSSDDGIRMLYLDFGGKDGEIQLDLHSCPKPIVFIIHSFLSAKITRLGLVA

SEQ ID NO: 1028582 - protein, 102 aa, Homo sapiens
DKERRRDERERSTSKKKKSKDKEKDRERKSESDKDVKQVTRDYDEEEQGYDSEKEKKEEKKPIETGSPKTKECSVEKGTGDSLRESKVNGDDHHEEDMDMSD

SEQ ID NO: 1028583 - protein, 102 aa, Homo sapiens; identical to SEQ ID NO: 1028582

SEQ ID NO: 1028584 - protein, 151 aa, Homo sapiens
QDAPFAPPPQVPIRRGAAPPPGGAPSKSQGEAAKLGGFQVPAPDGQFAFLIPNGAFANSGPVIPVTSNSGTSREHKKKKNQQANEHHDGGRGKGEATPKPNPIFPPNSKQEFKKWERRGFFFISGYFVVFNFLRRLLFEERAVLSDWPHAL

SEQ ID NO: 1028585 - protein, 34 aa, Homo sapiens
MTTFLTTKTVPLALCPGPLAFWTSSVLLWRKCNS

SEQ ID NO: 1028586 - protein, 88 aa, Homo sapiens
MAKRYELPDAAWDLVADIFTKNQRTGRPRADDRLMLNGILWVLCSGAAWRDMAEGFGPGSTIYQGFRGWRDCGALDQMLKGLHIRWNE

SEQ ID NO: 1028587 - protein, 80 aa, Homo sapiens
PVDLTLRKLYKLLSLFSHELFCPYPINKLGACCRGIGGLWPEVTSEAIGILFGFATSDLPPSWGKTATRGGCTGPELFLE

SEQ ID NO: 1028588 - protein, 176 aa, Homo sapiens
GSTDGNGAERLFAELRKMNARGLGSELKDSIPVTELSASGPFESHDLLRKGFSCVKNELLPSHPLELSEKNFQLNQDKMNFSTLRNIQGLFAPLKLPDGIQGSAAGSASSISFKLKSFTGCFEGNDETIGFEDILNDPSQRESHGEKQTWMGGIITLGFTCNSVLFIGNRGLTSGL

SEQ ID NO: 1028589 - protein, 107 aa, Homo sapiens
MAWLEKTVQCNRDVVTLSCCQPLKMQKKQGPYDVSGPTREVTLGAQNLSESAAVKEILKEQENRKGLIAAICAGPTALLAHEIGAGSKVTTYPLARDEMMTGGHSTP

SEQ ID NO: 1028590 - protein, 63 aa, Homo sapiens [sequence omitted]

SEQ ID NO: 1028591 - protein, 108 aa, Homo sapiens
MTPAPAPPPVPLRLGPFSDSISGRAARPAPSWAGVSQLEELVSRLLHLHFKDDKTKVSGDALQLMVELLKVFVVEAAVRGVRQAQAEDALRVDVDQLEKVLPQLLLDF

SEQ ID NO: 1028592 - protein, 195 aa, Homo sapiens
MVELLKVFVVGEPRPTLPPGTASGILRFSSGKTKTCFPVSHKGLNLGLLSLFVRSSSPRRAAGPGRRRAPCGRGPAGEGASAAAPGLLGISAVAEATPRGAPGPQKQALCFQRPLIRGREGPEGFGVDSNKISGSLQPVQKGQDCSALRALECPVGTLVWEGAAPGESLPLLPGTIVCMPPGVLQAGAGKGLASR

SEQ ID NO: 1028593 - protein, 235 aa, Homo sapiens
RGSCGARVEAAVMEGAGAGSGFRKELVSRLLHLHFKDDKTKRCGWGCGREVGPRVCPQGPFPATLQGQGLGRAGVCLEHPARAVGEESRITSPCLAVSGDALQLMVELLKVFVVGEPRPTLPPGTASGILRFSSGKTKTCFPVSHKGLNLGLLSLFVTGAVAWFWGLPVGVGGGTGPELRPSLGSGLRSPQHPPPLAFLTAEAAVRGVRQAQAEDALRVDVDQLEKVLPQLLLDF

SEQ ID NO: 1028594 - protein, 63 aa, Homo sapiens [sequence omitted]

SEQ ID NO: 1028595 - protein, 75 aa, Homo sapiens
RGSCGARVEAAVMEGAGAGSGFRKELVSRLLHLHFKDDKTKEAAVRGVRQAQAEDALRVDVDQLEKVLPQLLLDF

SEQ ID NO: 1028596 - protein, 93 aa, Homo sapiens
RGSCGARVEAAVMEGAGAGSGFRKELVSRLLHLHFKDDKTKVSGDALQLMVELLKVFVVEAAVRGVRQAQAEDALRVDVDQLEKVLPQLLLDF

SEQ ID NO: 1028597 - protein, 244 aa, Homo sapiens
RGSCGARVEAAVMEGAGAGSGFRKELVSRLLHLHFKDDKTKVSGDALQLMVELLKVFVVGEPRPTLPPGTASGILRFSSGKTKTCFPVSHKGLNLGLLSLFVRSSSPRRAAGPGRRRAPCGRGPAGEGASAAAPGLLGISAVAEATPRGAPGPQKQALCFQRPLIRGREGPEGFGVDSNKISGSLQPVQKGQDCSALRALECPVGTLVWEGAAPGESLPLLPGTIVCMPPGVLQAGAGKGLASR

SEQ ID NO: 1028598 - protein, 154 aa, Homo sapiens
LGAFCVDVDQLEKVPPQLVRELGRGASGGARLAGPKCFSSAAAPGLLGISAVAEATPRGAPGPQKQALCFQRPLIRGREGPEGFGVDSNKISGSLQPVQKGQDCSALRALECPVGTLVWEGAAPGESLPLLPGTIVCMPPGVLQAGAGKGLASR

SEQ ID NO: 1028599 - protein, 93 aa, Homo sapiens; identical to SEQ ID NO: 1028596

SEQ ID NO: 1028600 - protein, 63 aa, Homo sapiens [sequence omitted]

SEQ ID NO: 1028601 - protein, 63 aa, Homo sapiens [sequence omitted]

SEQ ID NO: 1028602 - protein, 127 aa, Homo sapiens [sequence omitted]

SEQ ID NO: 1028603 - protein, 37 aa, Homo sapiens
MKHYILKRNQSFCTTVNLDKLWTLVSEQTRVNASVEV

SEQ ID NO: 1028604 - protein, 47 aa, Homo sapiens
MCEVSDGEVSDGEVSDGEVSDAKFPMDETTQKEGTQASEGYLSQSHG

SEQ ID NO: 1028605 - protein, 221 aa, Homo sapiens
SDTQLNCSFSCSSKEEVLSIFHWEDFSSSFYFVNLFSDLEGFVELPPQLSLGGVVGGVHCQDLPALVTLVLHPQSARGFVADLPAHSPVIVAFSYEFCWRVLEGRAVEVDVHGLLSLMYDLEEGLEHGRGSPGARYGEKAIKLRTRRDIGKEEVRTSVGQIKAVSGRILRLPGCENQSWKRWSMMSERPEEVVSNTTRCAYVAVSFYKTEQIEDDHSCDRR

SEQ ID NO: 1028606 - protein, 101 aa, Homo sapiens
MKGGKRITTHRLSGPHTGDGLTCRIGHPGCMRLCGILFSRVRDKKAVVSKQVFVVENEPALDHQVNEPTHCKPAQGQLPPSQWDNLQHDLTTAMWSRLRPL

SEQ ID NO: 1028607 - protein, 282 aa, Homo sapiens
RGQYTLGEAGVNRPRAAAPNPADGTPKVLLLSGQPASAAGAPAGPGPAAHGASPERGQPGGSERGAAPGAASDSAVTHLSPEEKALRRKRKNRVAAQTARDRKKARMSELEQQVVDLEEENQKLLLENQLLREKTHGLVVENQELRQRLGDGCPGCVKRRRKPRGMKCGQWPGLLSPQHVRLRAPLQLVQAQLSPLQKISPVDSGGIDSSDSESDILVGILDNVDPVMFFKVPFPEPASVEELPEVYPEGPSSYQLLSLSVGAVISQAGGLNELIRFDAIFP

SEQ ID NO: 1028608 - protein, 283 aa, Homo sapiens
AGPCVPHEPCVLSDLNLAPRGSPRGRQPRFQNDYYLDLPPLKIFSICIKMGPQIFHKTSELGLHSYELPRADQTKTKKTLAKPNIMNVVVLDGVRTPFLLTGTAYKDLMPHDLARSSCLRLCCIGPVSLRKSLIISSLVQLFMKCKTSNVAREGCLGTGLLVTRLLLTLSPWLSISANQAMTTGVGLIASGQCDVIVAGGVESMSDVPIQSLKERMRHTDALISHKAQIYGPATVLQSLNSRFNFLSTWSSLRFLKFSSSETMAHSADRTGRALACSRVAPGC

SEQ ID NO: 1028609 - protein, 283 aa, Homo sapiens
AEDQHRLYQQIKAGAYDFPCVRNGTLSAPEAKDLINKMLTIKRHPKRITAAEALKHPWISHRSTVASCSAQTGDLELLKKFNARRKLKGAILTTMLATRNFSGGKSGGNKKSDGVKESSESTNTTIEDEDTKVRKQEIIKVTEQLIEAISNWRMYESYTKMCDPGMTAFEPEALGNLGRGPGLSIDSICENLVGPGTCKPDDTPPFLKSPKCTLMGQTEYSLALQYHPASRKITMRAARTGIPTANAHKSDGRPRVICQPPSERVKWAELGANLTEQNRREHT

SEQ ID NO: 1028610 - protein, 294 aa, Homo sapiens
AEDQHRLYQQIKAGAYDFPCVRNGTLSAPEAKDLINKMLTIKRHPKRITAAEALKHPWISHRSTVASCSAQTGDLELLKKFNARRKLKGAILTTMLATRNFSGGKSGGNKKSDGVKKRKSSSSVQLMESSESTNTTIEDEDTKVRKQEIIKVTEQLIEAISNWRMYESYTKMCDPGMTAFEPEALGNLGRGPGLSIDSICENLVGPGTCKPDDTPPFLKSPKCTLMGQTEYSLALQYNPESRKITMRAARTGIPTANAHKSDGRPRVICQPPSERVKWAELGANLTEQNRREHT

SEQ ID NO: 1028611 - protein, 219 aa, Homo sapiens
TSGTRTGRSLDPVIAGRTLGCGPAHGAGEVGRGSRSACVLFDMKGRQGSAEAVIKQLALDPHLITHAFFRLEGLATGVQATIGLERRGGVGKHADFRRELVEQAGALSEGVVGLAAIGVVAGEVVGALFEVFEARTDHAAQAVGEDDLVLQVECVAFGLFEEVGTGAYAVGFGLAVHRLVDVDGIVPCDRRHALFLCEYPRTRYRSTVHVANCPYRTPR

SEQ ID NO: 1028612 - protein, 239 aa, Homo sapiens
SKTRSCRFPVVNQAPECRFGGGILGPLGKRRDLARASEPRTEGARRAGPQPRPLADPAMDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNCGERLEKAGSSAQSLRHQDRQASRNRIPPANLTERVAGSPLKKSGQKHRERRTQTVGPPWWGALRVLARIEPGG

SEQ ID NO: 1028613 - protein, 283 aa, Homo sapiens
SKTRSCRFPVVNQAPECRFGGGILGPLGKRRDLARASEPRTEGARRAGPQPRPLADPAMDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLMIPPFSSYLLLSLAKFIMSLLDATALGMLRSLGAFVHLRAPPRGVVGGERWWAPVVGAVTTAGVAPLRGLMSVQSDAGGVVDAAQFCVADQGNVVPRAGVREPGGCYQGSSWCGSAGRGLGVRPHWFV

SEQ ID NO: 1028614 - protein, 109 aa, Homo sapiens
DRYKSSSVPVFPFVWFHPMGHYPVHRCSEMKLKASLVFSLDYSVVARKCSFVILNYFFETGSCSITQAGVQWHNHGSLQPQSPRLKQSFSLNILSTWDQRHTPPHPANF

SEQ ID NO: 1028615 - protein, 237 aa, Homo sapiens
AFSCCCCAPSPRGGQFQPAPASVPARLARAPAMGLTVSCALFCGSFGKKQMRILMVGLDAAGKTTILYKLKLGEIVTTIPTIGFNVETVEYKNICFTVWDVGGQDKIRALWRHYFQNTQGLIFVVDSNDREPGAKNLLMTSRRWTDELRDAALLVQATKQDLPTATARERADWQAGGYQHLHSPARREGPGTPGDHQKATGQEERARELADHNELNTEDKPAKGHGTLTARTDTMRT

SEQ ID NO: 1028616 - protein, 99 aa, Homo sapiens
AFSCCCCAPSPRGGQFQPAPASVPARLARAPAMGLTVSCALFCGSFGKKQMRILMVGLDAAGKTTILYKLKLGEIVTTIPTIGFNVETVEYKNICFTVW

SEQ ID NO: 1028617 - protein, 244 aa, Homo sapiens
MLGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTEGLVRGQKVLDSGAPIKIPVGPETLGRIMNVIGEPIDERGPIKTKQFAPIHAEAPEFMEMSVEQEILVTGIKVVDLLAPYAKGGKTWAFGGAGVGKTVLIMEVNQQCRKGHGGYPGVGWMVVRGPEKG

SEQ ID NO: 1028618 - protein, 128 aa, Homo sapiens
LWVYPPGFGICLTHAARPRCRTAMLGFVGRVAAAPASGALRRLTPSASLPPAQLLLRAAPTAVHPVRDYAAQTSPSPKAGAASHNMHDIIHMHKLQMRENNRNVKKKSNHPIVAMKAPVTVYMQACCM

SEQ ID NO: 1028619 - protein, 377 aa, Homo sapiens
SQSAPGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGQHHLPSSKACRALVLRQHGSGCWRAMIPRRVIEPVQAPVPVDVLQRVFVRVTVLRPGDRVLATGEPVRLAGGPKAPCRREGGPPSGEFDL

SEQ ID NO: 1028620 - protein, 261 aa, Homo sapiens
ALQEYLVWGEPTEYYTPEVKEIRCIVMSAVTCVRTHQTVHRVAGSAVPSMKYLYMNGSLKLDPYSYPNESPQCITPGCHTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYPEVHRPSHFLNFAFLQEGEVYSADREDLYACPFPCLLLQPPEAEASAPPDRPLTFSSLASFPLSVLVLLTS

SEQ ID NO: 1028621 - protein, 212 aa, Homo sapiens
VIFAPSRWVAEPSEGEAPAPTGQPLVLEQGVLYLRRYREYERRLAIGLRRIAAARLPPAESAAVATVFAALFPQARAGQDRQASAAALALQRALLLVTGGPGTGKTTTIARLLLLRVAQARQQGQASLRIALAAPTGRAAERMAESLRAAAGYVSAAGGDAALFAALPSGASTVHRLLGVIPDTPRFRHCEDNPLPYDVIVVDEASMMFTSR

SEQ ID NO: 1028622 - protein, 160 aa, Homo sapiens
MRTIRSDHNVLSATDCLTPQAVTAQPGIVFDTAVPPAILPRLTPEQPHSVPPARTAQRALLSDWWVYSFTQLAHAKAEPAPDAGRRIAEPLTGGAGRTSLATGCHPTVPAWERSARRPPFLSASVLVWHLHEVFERTDFLAWSTWRANAPVPATERAVLL

SEQ ID NO: 1028623 - protein, 168 aa, Homo sapiens
PNSALWLATGTFYQTERTALWPLLGDPQAVTAQPGIVFDTAVPPAILPRLTPEQPHSVPPARTAQRALLSDWWVYSFTQLAHAKAEPAPDAGRRIAEPLTGGAGRTSLATGCHPTVPAWERSARRPPFLSASVLVWHLHEVFERTDFLAWSTWRANAPVPATERAVLL

SEQ ID NO: 1028624 - protein, 232 aa, Homo sapiens
PNSALWLATGTFYQTERTALWPLLGDPQAVTAQPGIVFDTAVPPAILPRLTPEQPHSVPPARTAQRALLSDWWVWLPPAESAAVATVFAALFPQARAGQDRQASAAALALQRALLLVTGGPGTGKTTTIARLLLLRVAQARQQGQASLRIALAAPTGRAAERMAESLRAAAGYVSAAGGDAALFAALPSGASTVHRLLGVIPDTPRFRHCEDNPLPYDVIVVDEASMMFTSR

SEQ ID NO: 1028625 - protein, 170 aa, Homo sapiens
PNSALWLATGTFYQTERTALWPLLGDPQAVTAQPGIVFDTAVPPAILPRLTPEQPHSVPPARTAQRALLSDWWVYSFTQLAQPKRSLLPLAAPTGRAAERMAESLRAAAGYVSAAGGDAALFAALPSGASTVHRLLGVIPDTPRFRHCEDNPLPYDVIVVDEASMMFTSR

SEQ ID NO: 1028626 - protein, 70 aa, Homo sapiens
MAESLRAAAGYVSAAGGDAALFAALPSGASTVHRLLGVIPDTPRFRHCEDNPLPYDVIVVDEASMMFTSR

SEQ ID NO: 1028627 - protein, 249 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLPGGSQDQGDRSQAQIKLQARS

SEQ ID NO: 1028628 - protein, 260 aa, Homo sapiens
GCEIAARSVKIVLIILICSGRLDVQYLRVRTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLPGGSQDQGDRSQAQIKLQARS

SEQ ID NO: 1028629 - protein, 242 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDENEVGVAIQEKLRELVDEGLVKAIGISNFNHLQVEMILNKPGLKYKPAVNQIECHPYLTQEKLIQYCQSKGIVVTAYSPLGSPDRPWAKPEDPSLPGGSQDQGDRSQAQIKLQARS

SEQ ID NO: 1028630 - protein, 113 aa, Homo sapiens
MASRLLLNNGAKMPILGLGTWKSPPGQVTEAVKVAIDVGYRHIDCAHVYQNENEVGVAIQEKLREQVVKREELFIVSKLWLQRYPLEERGLVVNREALPRKTTPANPLKGLAP

SEQ ID NO: 1028631 - protein, 248 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCRPRILVDAKAPRFLEGLGQAEAFSGIQTRAGRKNNAGCRSLEKWGPFP

SEQ ID NO: 1028632 - protein, 256 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLPGGSQDQGDRSQAQFPKAVTPERIAENL

SEQ ID NO: 1028633 - protein, 236 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVSHVYQNENEVGVAIQEKLREQVVKRENFKVFDFELSSQDMTTLLRYNRNWRVCALLSCTSTRITPSMKSFEAVVACSSQVDYTCVSWLIFFLANVGYAGAVISV

SEQ ID NO: 1028634 - protein, 148 aa, Homo sapiens
MRQLINPAWFVLMLLCGTDATFVPGFCPNLFVPEVCQLAAAILVLFHHFQPLQGLEDPAGHTLGASAEVAGLRRRFSALSPIDLGHGANPSATPGWYRCRSCGSSSLCKTSSHRREQALVCLCQLDGIHPFWWTYRFPGLLRGRLPKL

SEQ ID NO: 1028635 - protein, 170 aa, Homo sapiens
MVCSNASMWDRCHHRAGDYVQISIVPEVCQLAAAILVLFHHFQPLQGLEDPAGHTLGASAEVAGLRRRFSALSPIDLGHGANPSATLDGTGAAAVEAARCVEPVLIVGSKLLCCQLTDHHSGLQLPTFESCQSSDDSVFTLTDSASRSRCIQIDDTLNHSVGFVSPHKRA

SEQ ID NO: 1028636 - protein, 203 aa, Homo sapiens
STEGGRTAQLTAVLRKLLDPRLISTEENTQAAETMGPLSAPPCTQHITWKGLLLTASLLNFWNLPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRGDGTRGVTGHFTFTLHLETPKPSISSSNLNPRGGHGGCDLNL

SEQ ID NO: 1028637 - protein, 301 aa, Homo sapiens
STEGGRTAQLTAVLRKLLDPRLISTEENTQAAETMGPLSAPPCTQHITWKGLLLTASLLNFWNLPTTAQVTIEAQPPKVSEGKDVLLLVHNLPQNLAGYIWYKGQMTYLYHYITSYVVDGQRIIYGGGGGGEEEEEGGGPPGCIREMFTAGRARDPTTTFIKGYASGDWEGVTGHFTFTLHLETPKPSISSSNLNPREAMEAVILTCDPATPAASYQWWMNGQSLPIFFTVLQLVQKPNRTLFSILVSQKYTCKDPIECEIRNPSECPAAVTQSPWNLLASSPKPYITINNLNPRENKDVL

SEQ ID NO: 1028638 - protein, 166 aa, Homo sapiens
STEGGRTAQLTAVLRKLLDPRLISTEENTQAAETMGPLSAPPCTQHITWKGLLLTASLLNFWNLPTTAQVTIEAQPPKVSEGKDVLLLVHNLPQNLAGYIWYKGQMTYLYHYITSYVVDGQRIIYGCGPAIVDGGNKYFHIAFPRPAMFTPEGRQSLTTFTPSVKA

SEQ ID NO: 1028639 - protein, 307 aa, Homo sapiens
LTPGRREATELLGRRTRTLVPGAGARLGDTFLLALSNAVQAAGPTDYIGPGAGGDTWAMELKLISIHAHLLLAGAFADTRVDCAHTVTCGPRLKVPLDLNAFDVQASPNEGFVNQNITIFYRDRLGLYPRLRFCLEGLCMVVCHMNVSLWCSTEDDAARNVVEHYIRTQESAGLVVIDWEDWRPVVGCSNVAGAKMCIAGYHASYDGADTVTLDWPPDRIVKQAQYEFEVAAETVHAGRHMRLIVIGTCGPGDPLGLLPSFLTATIMIMCKNWESYSRSAALMLTRETAMTMSGLCCGLRARPLPVC

SEQ ID NO: 1028640 - protein, 73 aa, Homo sapiens
SPLYTFRSRLRDLVFFLIDHGFCFFVDLYFCSAFFLPRSEMWIVCKGDILLTPTSVLSYSVKLHVFLKGLRSN

SEQ ID NO: 1028641 - protein, 238 aa, Homo sapiens
QCVRLSKFNSERSIFIPPDGEFELMRYRTTKNIILPFRVIPLVREVGRTKLEVKVVIKSNFKPSLLAKKIEVRIPTPLNTSGVQVICMKGASENAIVWKIKRMAGMKESQISAEIFFFFFKKKWARPPISMNFEVPFAPSGLKVRYLKVFEPKLNYSDHDVIKCHCGQVYAHPFDDIMVVRYIGRSGIYENSLLAATRQLAHLPSHPPPQVQVPLPPPPHISVSSLLLCCLPFAPARV

SEQ ID NO: 1028642 - protein, 223 aa, Homo sapiens
QCVRLSKFNSERSIFIPPDGEFELMRYRTTKNIILPFRVIPLVREVGRTKLEVKVVIKSNFKPSLLAKKIEVRIPTPLNTSGVQVICMKGASENAIVWKIKRMAGMKESQISAEIFFFFFKKKWARPPISMNFEVPFAPSGLKVRYLKVFEPKLNYSDHDVIKWVRYIGRSGIYENSLLAATRQLAHLPSHPPPQVQVPLPPPPHISVSSLLLCCLPFAPARV

SEQ ID NO: 1028643 - protein, 74 aa, Homo sapiens
QSPNSAQSPNSAQSPNSAQSPNSAQSPNSAQSPNSAQSPNSAQSPNSAPAEKYSGGSTVHNSIIMRGTALNHSA

SEQ ID NO: 1028644 - protein, 65 aa, Homo sapiens
ESKQCPESKHVPTSPNSAQSPNSAQSPNSAQSPNSAQSPNSAQSPNSAQSPNSAQSPNSALLEGP

SEQ ID NO: 1028645 - protein, 83 aa, Homo sapiens
RGADIPVVLLCRGSSCCHEGRTGLPTAEPELRARAARCVAPSVRSSTRRSCGHQLTLQVLDFVQGPCFAQGDGLIKLYVKLYQ

SEQ ID NO: 1028646 - protein, 94 aa, Homo sapiens
MSNPSSPPPYEDRLPLLTQALCAPGGYGAAICAARRSIRAYPGYPAGWLRVTLAGPQPLHPMPIYGPGHGYYGEEETVSDIFEPEEDDRKVQHT

SEQ ID NO: 1028647 - protein, 102 aa, Homo sapiens
SSLGNKSLTKDPVSLRYRTRRCSNLGLRARETSEGEKCPARTPLCVLCFVFETESSSYCPGWSSSYCPGWSSSYCPGWSSSYCPGWSSSYAQAGVALLARQM

SEQ ID NO: 1028648 - protein, 118 aa, Homo sapiens
SVPEDNDVREDHDVREDHDVREDHDVREDHDVREDHDVREDHDVREDHDVREDHDVREDHDVREDHDVREDHDVREDHDVREDHDVRGLSGLVGDHDVRVTIIHNNITPGRESLCKSP

SEQ ID NO: 1028649 - protein, 90 aa, Homo sapiens
SVPEDNDVREDHDVREDHDVREDHDVREDHDVREDHDVREDHDVREDHDVREDHDVREDHDVREDHDVREDHDVREDHDVREDHDVRVPY

SEQ ID NO: 1028650 - protein, 54 aa, Homo sapiens
SVPEDNDVREDHDVREDHDVREDHDVREDHDVREEKLPVLTAMCSSLSICKLLC

SEQ ID NO: 1028651 - protein, 76 aa, Homo sapiens
SAEHTVGLVALLLEAITSPLVSVRYCQRCIRVISDAGKSSPWSKIFPMIFRYCGGSTFSDLSLRLHTLRGYRAQCI

SEQ ID NO: 1028652 - protein, 446 aa, Homo sapiens
MREIVHIQAGQCGNQIGTKFWEVISDEHGIDPAGGYVGDSALQLERINVYYNESSSQKYVPRAALVDLEPGTMDSVRSGPFGQLFRPDNFIFGQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQELFKRISEQFSAMFRRKAFLHWFTGEGMDEMEFTEAESNMNDLVSEYQQYQDATANDGEEAFEDEEEEIDG

SEQ ID NO: 1028653 - protein, 362 aa, Homo sapiens
MREIVHIQAGQCGNQIGTKFWEVISDEHGIDPAGGYVGDSALQLERINVYYNESSSQKYVPRAALVDLEPGTMDSVRSGPFGQLFRPDNFIFGQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAAGIRAKAELTRGTGVRASPTGGQPSAPKRHTSGTTKEGTAPEDTSPQRRAHTPHCEKRVTK

SEQ ID NO: 1028654 - protein, 446 aa, Homo sapiens; identical to SEQ ID NO: 1028652

SEQ ID NO: 1028655 - protein, 374 aa, Homo sapiens
MDSVRSGPFGQLFRPDNFIFGQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQELFKRISEQFSAMFRRKAFLHWFTGEGMDEMEFTEAESNMNDLVSEYQQYQDATANDGEEAFEDEEEEIDG

SEQ ID NO: 1028656 - protein, 409 aa, Homo sapiens
MREIVHIQAGQCGNQIGTKFWEVISDEHGIDPAGGYVGDSALQLERINVYYNESSCQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQELFKRISEQFSAMFRRKAFLHWFTGEGMDEMEFTEAESNMNDLVSEYQQYQDATANDGEEAFEDEEEEIDG

SEQ ID NO: 1028657 - protein, 308 aa, Homo sapiens
MREIVHIQAGQCGNQIGTKFWEVISDEHGIDPAGGYVGDSALQLERINVYYNESSSQKYVPRAALVDLEPGTMDSVRSGPFGQLFRPDNFIFGQTGAGNNWAKGHYTEGAELVDAVLDVVRKECEHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQELFKRISEQFSAMFRRKAFLHWFTGEGMDEMEFTEAESNMNDLVSEYQQYQDATANDGEEAFEDEEEEIDG

SEQ ID NO: 1028658 - protein, 142 aa, Homo sapiens
MSGGPIKICLSKRPGLSSAGSRISGRLVPAKMTTFVVVLKPSISTSSWLSVFSCSLCPPKLPLPLFLPTASISSMKRMQGAFFRARANKSRTLAGPTPTNISKNSDPLTVMKGTLASPAVALASSVFPVPGGPVRTGTLWIL

SEQ ID NO: 1028659 - protein, 532 aa, Homo sapiens
MREIVHIQAGQCGNQIGTKFWEVISDEHGIDPAGGYVGDSALQLERINVYYNESSSQKYVPRAALVDLEPGTMDSVRSGPFGQLFRPDNFIFEFLFNMEQPGQNVYTSLKLTSSYFDLPKNVPVHLLSCTVGGCLFPRPLSLANSTSWNHFTPSLSVTKHGDGAALSCLNGTGLIFVAGQTGAGNNWAKGHYTEGAELVDAVLDVVRKECEHCDCLQGFQLTHSLGGGTGSGMGTLLISKIREEFPDRIMNTFSVMPSPKVSDTVVEPYNATLSVHQLVENTDETYCIDNEALYDICFRTLKLTTPTYGDLNHLVSATMSGVTTSLRFPGQLNADLRKLAVNMVPFPRLHFFMPGFAPLTSRGSQQYRALTVPELTQQMFDARNMMAACDPRHGRYLTVATVFRGPMSMKEVDEQMLAIQSKNSSYFVEWIPNNVKVAVCDIPPRGLKMASTFIGNSTAIQELFKRISEQFSAMFRRKAFLHWFTGEGMDEMEFTEAESNMNDLVSEYQQYQDATANDGEEAFEDEEEEIDG

SEQ ID NO: 1028660 - protein, 142 aa, Homo sapiens; identical to SEQ ID NO: 1028658

SEQ ID NO: 1028661 - protein, 114 aa, Homo sapiens
AGGSGAPGIRPPGRLGWARVAASRALGSERLSPRLALPKFWEVISDEHGIDPAGGYVGDSALQLERINVYYNESSSQKYVPRAALVDLEPGTMDSVRSGPFGQLFRPDNFIFGV

SEQ ID NO: 1028662 - protein, 126 aa, Homo sapiens
MKEHTGRLVIGDHKSTSHFRTGEEDKKINEELESQYQQSMDSKLSGRYRRHCGLGFSEVEDHDGEGDVAGDDDDDDDDSPDPESPDDSESDSESEKEESAEELQAAEHPDEVEDPKNKKDAKALLT

SEQ ID NO: 1028663 - protein, 126 aa, Homo sapiens; identical to SEQ ID NO: 1028662

SEQ ID NO: 1028664 - protein, 100 aa, Homo sapiens
MAMAEVEAYYSLEYAGRWFERTRLSGLHGRAQEETRRMSGNASLNLYEGQKFEAHTLAGELRKKGEEGNSEKVEWSLVKGFYVLFGGPLLSRALYIIETA

SEQ ID NO: 1028665 - protein, 31 aa, Homo sapiens
MASESFEWTEAWSLSTHILHILEKPTNRDGV

SEQ ID NO: 1028666 - protein, 204 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSLRWNGIEPTVEPTLDYVRQPWTSRANRGLVANRGLVANRGLVANRGLVANRGLVANRGLVANPGLVANRGLVANRGLVANRGLVPTVD

SEQ ID NO: 1028667 - protein, 127 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSLRWNGIEPTVD

SEQ ID NO: 1028668 - protein, 233 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSLRWNGIVHGWLLVHGWLLVHGWLLVHGWLLVHGWLLVHGWLLVHGWLLVHGWLLVHGWLLVHGWLHGWLLVHGWLCCCRFQVVGHLMASESFEWTEAWSLSTHILHILEKPTNRDGV

SEQ ID NO: 1028669 - protein, 186 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSLRWNGIVHGWLLVHGWLLVHGWLLVHGWLLVHGWLLVHGWLLVHGWLLVHGWLLVHGWLLVHGWLTPPGN

SEQ ID NO: 1028670 - protein, 250 aa, Homo sapiens
TSPRLAYEYGLYHIAESWPIPFQRRLVANRGLVANRGLVANRGLVANRGRTSPRLATSPRLATSPRLATSPRLATSPRLATSPRLATSPRLATSPRLATSPRLARLGLELLTSGDLPSSASQIAGITGMSHRARLATSPRLATSPRLATSPRLATSPRLATSLRWNGIEPTVEPTLDYVRQPWTSRANRGLVANRGLVANRGLVANRGLVANRGLVANRGLVANPGLVANRGLVANRGLVANRGLVPTVD

SEQ ID NO: 1028671 - protein, 210 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSPRLATSLRWNGIEPTVEPTLDYVRQPWTSRANRGLVANRGLVANRGLVANRGLVANRGLVANRGLVANPGLVANRGLVANRGLVANRGLVPTVD

SEQ ID NO: 1028672 - protein, 106 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLARLWSRTPDLR

SEQ ID NO: 1028673 - protein, 176 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLAGGPFPLYYSMTSDKLHISLFQPSNRGLVANRGLVANRGLVANRGLVANRGLVANPGLVANRGLVANRGLVANRGLVPTVD

SEQ ID NO: 1028674 - protein, 31 aa, Homo sapiens; identical to SEQ ID NO: 1028665

SEQ ID NO: 1028675 - protein, 149 aa, Homo sapiens
MGRQTQCLKTFQSPCASQPTSPRLATSPRLATSPRLATSPRLATSPRLATSPRLATSPRLATSPRLATSPRLATSPRLATSPRLATSPRLATSPRLAPRLATSPRLAVRCRFQVVDHLMASESFEWTEAWSLSTHILHILEKPTNRDGV

SEQ ID NO: 1028676 - protein, 146 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLAGSYSTVGYRLRVIRSLALSPRLECSGMISAYSTHHSPGSSSSSASANRGL

SEQ ID NO: 1028677 - protein, 112 aa, Homo sapiens
LVHGWLMNMRLYHIAETWPIPFQRRLVANRGLVANRGLVANRGLVANRGRQPWTSSQPWTSSQPWTSSQPWTSSQPWTSSQPWTSSQPWTSSQPWTSSQPWTSTNRGLVEKT

SEQ ID NO: 1028678 - protein, 130 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLALSVFSVLLLNSIPAELAYRGLV

SEQ ID NO: 1028679 - protein, 198 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSLRWNGIDEGTTGVSQPWTSSQPWTSSQPWTSSQPWTSSQPWTSSQPWTSSQPWTSSQPWTSSQPWTSSQPWTSTNRGLVEKT

SEQ ID NO: 1028680 - protein, 210 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSLRWNGIVHGWLLVHGWLLVHGWLLVHGWLLVHGWLLVHGWLLVHGWLLVHGWLLVHGWLLVHGWLTPCNPSTLGGTRQGRSPELGSSRPQHVTS

SEQ ID NO: 1028681 - protein, 191 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSLRWNGIVHGWLLVHGWLLVHGWLLVHGWLLVHGWLLVHGWLLVHGWLLVHGWLLVHGWLLVHGWLQSTVAQAGVQ

SEQ ID NO: 1028682 - protein, 139 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLATSPRLATSPRLATSPRLATSLRWNGIEPTVD

SEQ ID NO: 1028683 - protein, 112 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLAHACNPSTLGGLDGRIV

SEQ ID NO: 1028684 - protein, 177 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLATSPRLATSPRLASQPWTSSQPWTSSQPWTSSQPWTSSQPWTSSQPWTSSQPWTSSQPWTSSQPWTSSQPWTSTNRGLVEKT

SEQ ID NO: 1028685 - protein, 191 aa, Homo sapiens
MRLYHIAESWPIPFQRRLVANRGLVANRGLVANRGLVANRGRTSPRLATSPRLATSPRLATSPRLATSPRLATSPRLATSLHGWLLVHGWLLVHGWLLVHGWLLVHGWLLVHGWLLVHGWLLVHGWLLVHGWLLVHGWLHGWLLVHGWLCCCRFQVVGHLMASESFEWTEAWSLSTHILHILEKPTNRDGV

SEQ ID NO: 1028686 - protein, 111 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLADYDQYALLYSQLLVA

SEQ ID NO: 1028687 - protein, 127 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPRLAKEEVNRPRSGNGAGQNSRHTVNDAPGKPTVT

SEQ ID NO: 1028688 - protein, 102 aa, Homo sapiens
MRLYHIAESWPIPFQRRLVANRGLVANRGLVANRGLVANRGRTSPRLATSPRLATSPRLATSPRLATSPRLATSPRLATSPRLATSPRLATSPLQPPPPGLK

SEQ ID NO: 1028689 - protein, 307 aa, Homo sapiens
QSSAQAKQASICTCSQSCSHHEPPACRVSSASYGGGFGGGSCQLGGGRGVSTCSTRFVSGGSAGGYGGGVSCGFGGGAGSGFGGGYGGGLGGGYGGGLGGGFGGGFAGGFVDFGACDGWLLTGNEKITMQNLNDLLASYLEKVRALEEANADLEVKIRDWHLKQSPGSPERDYRPYYKTIGMKLRDKDPETGTIENNRVILEIEQCHGWLVDRPYRRQVLRNELGLGAQSVEADINVAVPGLLDEVHLWSGEMTWENAETEDLNEELSLHLRKNHEREWRALAPVVGPGHCEFVPPGYTYRAANTGD

SEQ ID NO: 1028690 - protein, 356 aa, Homo sapiens
QSSAQAKQASICTCSQSCSHHEPPACRVSSASYGGGFGGGSCQLGGGRGVSTCSTRFVSGGSAGGYGGGVSCGFGGGAGSGFGGGYGGGLGGGYGGGQVNVEMDATPGIDLTRVLAEMREQYEAYMKKNHEEEMKEFSNQVVGQVNVGGGFGGGFAGGFVDFGACDGWLLTGNEKITMQNLNDCWLLYLEKVRALEEANADLEVKIRDWHLKQSPGSPERDYRPYYKTIGMKLRDKDPETGTIENNRVILEIEQCHGWLVDRPYRRQVLRIEAVPGAQSVEADINVAVPGLLDEVHLWSGEMTWENAETEDLNEELSLHLRKNHEREWRALAPVVGPGHCEFVPPGYTYRAANTGD

SEQ ID NO: 1028691 - protein, 289 aa, Homo sapiens
MSSPMYNASITDLEAKIAQLELSMAGQRDQGVARRVLSNQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEANLPNKPLLLQPEMDGQTDTTASPFQTPTARLYPPSWDCCEHASSCPRRPHPVPPGVWGIGFLCCIPFQLPPLSNLIQRDRARAQAESDRAPQPLCQKAQDVRRAGSPGEGQVSMNLFLQTEAFGSRPAA

SEQ ID NO: 1028692 - protein, 353 aa, Homo sapiens
QPLTLSSLSLISCEPCASTSTTIRSHSSSRRGFTCQLSQAPWGQPLWLQQRLLCPAPGCSGGLGGACGGAGFGSRSLYGLGGSKRISIGGGSCAISGRLWQQSRSPSYGFGGAGSGFGFGGGAGIGFGLGGGAGLAGGFWGPLASLCCPPLEASKGGQPVNQSLLDSPQTLQFRIPTIPAVLRGLRSREPDSGPFNNKFCLLHRQGAVPGSSTTNGSGTTQRWTLCLQGRRGHQRLLRACTLKPLFPEAVHSATFRQPAWTSHLSVGNRRPAVGLRSSRRPLQGPGGQDFTDTNLCGIDIQQAAQKADRTGTFADLLATTGLVHCLAHPLKPGVELRQPEARPLITGTETTFM

SEQ ID NO: 1028693 - protein, 110 aa, Homo sapiens
VCHSTYLLILFLTLPLSIVPSPHSLGFSHISLLSVPHTFQDNFWLTALSPACSFLEYHSLQIFTRLLLLDNKMTSHTAIKMNEIMLFAATCMELEAIILSELTQKQKTKY

SEQ ID NO: 1028694 - protein, 278 aa, Homo sapiens
MGVKASQTGFVVLVLLQCCSAYKLVCYYTSWSQYREGDGSCFPDALDRFLCTHIIYSLCQYKSTITSTPGSGTDVTLYGYAQGHLKNRNPKPEDSSRSVPEDGPSVVSKSLFQDMACQATQSRRTFIKSVPPFLRTHGFDGLDLAWLYPGRDKQHFTTLIKEMKAEFIKEAQPGKKQLLLSAALSAGKVTIDSSYDIAKISQHLDFISIMTYDFMEPGVGPQAITAPVPGQEDASPDRFSNTDYAVGYMFEGWGLLPVSLLMGIPNFGRSFTLGSSET

SEQ ID NO: 1028695 - protein, 69 aa, Homo sapiens
PFEQLPVRKYIVNVYQIYEDGEQSLILSTSQTTAPDAPPDPTVDHVDDTSIVVRLEQTPGYLKNIEYRA

SEQ ID NO: 1028696 - protein, 73 aa, Homo sapiens
MVASRVPPQHSHVACLFHVKWWRPGFLSSTRMSPASSNARMDVYARMDVYARMDVYARMDVYARMDVYARMDV

SEQ ID NO: 1028697 - protein, 192 aa, Homo sapiens
MPHYSLLNASASTGPFLSKHRGTQARGTKARGLRPPWPGMQVEACGLHLPFHHTQHPSSRAVGPQARVQTSVLTEAYIEGCGPGHLASATHSGPCDKRSHRQMSGSDVTLLPHSLSATAPCSGPKPVGPRFVLLPFFSPLYKPLHQSPEPSASGVPSNAGVPLRRNPSSQGPIGYTVQVPGGRKEGPETRLG

SEQ ID NO: 1028698 - protein, 196 aa, Homo sapiens
SGTGISRRDLNKEYSNRTQTKGQEAHEEVLKITSHQENAYEIYNEISLNTHWDRYITSKCIISSVVERCKGSTFRQCSNGRIVCPNMLWCNGADDCGDGSDEIPCNKTACGVGEFRCRDGTCIGNSSRCNQFVDCEDASDEMNCSATDCSSYFRLGVKGVLFQPCERPSLCYAPSWVCDGANDCGDYSDERDCPGV

SEQ ID NO: 1028699 - protein, 100 aa, Homo sapiens
RAGDLEDPLNAYTSSTLILLNALYFSTLYTSQRFILLNALYFSTLYTSQRFILLNALYFSTLYTSQRFILLNALYFLNALYFLNALYFLNALYFSFHFPV

SEQ ID NO: 1028700 - protein, 95 aa, Homo sapiens
CVRVIRGPPQRLYFLNAYHTSQRFILLNALYFSTLYTSQRFILLNALYFLNALYFLNALYFLNALYFLNALYFLNALYFLNALYFPQRFSFHFPV

SEQ ID NO: 1028701 - protein, 171 aa, Homo sapiens
HASTLNALYTQRLTSQRFILLNALYFSTLYTSQRFILLNALYFSTLYTSQRFILLNALYFSTLYTSQRFILLNALYFLNALYFLNALYFLNALYFSTLYTSSTLYTSQRFILPQRFILLNALYFLNALYFLNALYFLNALYFLNALYFLNALYFLNALYFLNALYFIPEMK

SEQ ID NO: 1028702 - protein, 179 aa, Homo sapiens
HASTLNALYTQRLTSQRFILLNALYFSTLYTSQRFILLNALYFSTLYTSQRFILLNALYFSTLYTSQRFILLNALYFLNALYFLNALYFLNALYFSTLYTSSTLYTSQRFILPQRFILLNALYFLNALYFLNALYFLNALYFLNALYFLNALYFLNALYFRIEFKYNIKYACFISRYEV

SEQ ID NO: 1028703 - protein, 143 aa, Homo sapiens
HASTLNALYTQRLTFSTLYTSQRFILLNALYFSTLYTSQRFILLNALYFSTLYTSQRFILLNALYFSTLYTSQRFILPQRFILPQRFILPQRFILLNALYFLNALYFSTLYTSLAPEVHAYLILYLNSIRKYKALRDPLITQL

SEQ ID NO: 1028704 - protein, 131 aa, Homo sapiens
SRFNPQRFIFSTLNFLNALYFSTLYTSQRFILLNALYFSTLYTSQRFILLNALYFSTLYTSQRFILLNALYFSTLYTSSTLYTSSTLYTSSTLYTSQRFILPQRFILLNALYFSTLYTSKIKKNKNVKYKR

SEQ ID NO: 1028705 - protein, 119 aa, Homo sapiens
HASTLNALYTQRLTFSTLYTSQRFILLNALYFSTLYTSQRFILLNALYFSTLYTSQRFILLNALYFSTLYTSQRFILPQRFILPQRFILPQRFILLNALYFIPGNIELRKYKGILYIAA

SEQ ID NO: 1028706 - protein, 123 aa, Homo sapiens
HASTLNALYTQRLTFSTLYTSQRFILLNALYFSTLYTSQRFILLNALYFSTLYTSQRFILLNALYFSTLYTSQRFILPQRFILPQRFILPQRFILLNADTSQRLTSQRLYFAQRFDTMTGNEE

SEQ ID NO: 1028707 - protein, 171 aa, Homo sapiens; identical to SEQ ID NO: 1028701

SEQ ID NO: 1028708 - protein, 136 aa, Homo sapiens
HASTLNALYTQRLTFSTLYTSQRFILLNALYFSTLYTSQRFILLNALYFSTLYTSQRFILLNALYFSTLYTSQRFILPQRFILPQRFILPQRFILLISFPGMKYKALRKYKALRKYKALRKYKALRKYKALRSIKR

SEQ ID NO: 1028709 - protein, 170 aa, Homo sapiens
HASTLNALYTQRLTSQRFILLNALYFSTLYTSQRFILLNALYFSTLYTSQRFILLNALYFSTLYTSQRFILLNALYFLNALYFLNALYFLNALYFSTLYTSSTLYTSQRFILPQRFILLNALYFLNALYFLNALYFLNALYFLNALYFLNALYFLNALYFPQRFSFHFPV

SEQ ID NO: 1028710 - protein, 120 aa, Homo sapiens
HASTLNALYTQRLTFSTLYTSQRFILLNALYFSTLYTSQRFILLNALYFSTLYTSQRFILLNALYFSTLYTSQRFILPQRFILPQRFILPQRFILLNALYFLNALYFSTLYTSFISRYEV

SEQ ID NO: 1028711 - protein, 155 aa, Homo sapiens
HASTLNALYTQRLTFSTLYTSQRFILLNALYFSTLYTSQRFILLNALYFSTLYTSQRFILLNALYFSTLYTSQRFILPQRFILPQRFILPQRFILLTQRFILLNALYFLNALYFLNALYFLNALYFLNALYFLNALYFLNALYFLNALYFIPEMK

SEQ ID NO: 1028712 - protein, 154 aa, Homo sapiens
HASTLNALYTQRLTFSTLYTSQRFILLNALYFSTLYTSQRFILLNALYFSTLYTSQRFILLNALYFSTLYTSQRFILPQRFILPQRFILPQRFILLTQRFILLNALYFLNALYFLNALYFLNALYFLNALYFLNALYFLNALYFPQRFSFHFPV

SEQ ID NO: 1028713 - protein, 125 aa, Homo sapiens
SRFNPQRFIFSTLNFLNALSILLNAYTSQRFILLNALYLLLNALYFSTLYTSQRFILLNALYFSTLYTSQRFILLNALYFSTLYTSQRFILLNALYFLNALYFLNALYFLNALYFSTLYTSYREI

SEQ ID NO: 1028714 - protein, 324 aa, Homo sapiens
FSLLSWPSRPALTLRRAYVNEVVTGPRMTPSHHWELCTSAARRRRKEEDEKVATPSWYLQIQGYHEVYRGLWKPEKSLSCGKGITREAQMWKVNVRKMPSNQNVSPSQRDEVIQWLAKLKYQFNLYPETFALASSLLDRFLATVKAHPKYLSCIAISCFFLAAKMWRKMRDFQYKGMARDSFCGCSSSEILRMERIILDKLNWDLHTATPLDFLHIFHAIAVSTRPQLLFSLPKWSPSQHLAGPYQATTSLYGLQPTSAIQRIHACSAMLVWNWGTHSCWVLLPLTWFERTLVPRSPGGLVPHLLPGFRPNRGYRPQGLACQGS

SEQ ID NO: 1028715 - protein, 85 aa, Homo sapiens
FSLLSWPSRPALTLRRAYVNEVVTGPRMTPSHHWELCTSAARRRRKEEDEKVATPSWYLQIQGYHEVYRGLWKPEKSLSCGKGNH

SEQ ID NO: 1028716 - protein, 227 aa, Homo sapiens
MDSCTKHIDEMTTPQQTNPQTKQERHDANFRKVRGILNRLNSCKKCDKLCLAASINVGVETKLILKGVILLMWTQALEEPKYSITDAQLCLRWNKMHHQPDGPAGEGQTRTEAKHKIPEHHNTKIPKKRNRTTNVDEGKRTSAARRRVSKSRGRRSRATTTQRNGTNIRTENIRENGNKEREKRQERNNRPRSTLVCSLNKTKPIERVRQTKQRENTNSDTLVFLAP

SEQ ID NO: 1028717 - protein, 132 aa, Homo sapiens
RENNVSRVVENGLSCVSFSGQFFNHYRLGSVLPIYRNDMNMKFFVFHIGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 1028718 - protein, 132 aa, Homo sapiens; identical to SEQ ID NO: 1028717

SEQ ID NO: 1028719 - protein, 132 aa, Homo sapiens; identical to SEQ ID NO: 1028717

SEQ ID NO: 1028720 - protein, 97 aa, Homo sapiens
GRGAAGETVWKGLAGMPPTSWRQEPQLCGMGTEQGCWIPVSSDKGSCPQVMERSFHMPSYGTQTLEGGVEKPHSLLSANPLWQQRALDPPHQMELTQ

SEQ ID NO: 1028721 - protein, 132 aa, Homo sapiens; identical to SEQ ID NO: 1028717

SEQ ID NO: 1028722 - protein, 132 aa, Homo sapiens; identical to SEQ ID NO: 1028717

SEQ ID NO: 1028723 - protein, 114 aa, Homo sapiens
GGVSGKGKKREDFGREGIVQRGGVLVFGESQEGDWGGVSFQGRVWTAEDGIVGFPNSCRISDIRFFTGEMPGQTMAATSFIFMNTFPNNSSLADESQTLKEANLVNAVIVQRLT

SEQ ID NO: 1028724 - protein, 94 aa, Homo sapiens
GEVQLRESEQMTKTKKRPQRARSTVFAIVMHQSQIISEISEAFNMIDQNRDGFIDKEDLHDMLASLGKNSTDEYLDAMMNEAPGPINFTMFLTM

SEQ ID NO: 1028725 - protein, 72 aa, Homo sapiens
NDPHRMDRRLQALMIAGSCLGVSWTDALLLFWTSSMIGYQESAELLDLDPEVDCLKANTNEVLWAVVAAFTK

SEQ ID NO: 1028726 - protein, 104 aa, Homo sapiens
MYLSSSRPIGPIYHPIEVLMLVSVARIQSPPHKPRSQIEPRSQIEPRSQIEPRSQIEPRSQIEPRSQIEPRSQIEPRSQIEPRSQIEPRSQIEPRSQIEPRSQL

SEQ ID NO: 1028727 - protein, 66 aa, Homo sapiens
MLTGSSSRVVRSSRVVRSSRVVRSSRVVRSSRVVRSSRVVRSSRVVRSSRVVRSSRVVRSSRVVSS

SEQ ID NO: 1028728 - protein, 83 aa, Homo sapiens
MPRQRGKSLSLQNLLNLAKLGGVEPRSQIEPRSQIEPRSQIEPRSQIEPRSQIEPRSQIEPRSQIEPRSQIEPRSQIEPRSQL

SEQ ID NO: 1028729 - protein, 85 aa, Homo sapiens
RASYSRVISTIGFRSSMWGQDIPMVEPRSQIEPRSQIEPRSQIEPRSQIEPRSQIEPRSQIEPRSQIEPRSQIEPRSQIEPRSQL

SEQ ID NO: 1028730 - protein, 96 aa, Homo sapiens
DKQYEITKHDVTGPALDAGDTDGEERWAPACNVGNRAANRIPHLVEGPRKAPLVQPRSQIEPRSQIEPRSQIEPRSQIEPRSQIEPRSQIEPRSQL

SEQ ID NO: 1028731 - protein, 91 aa, Homo sapiens
SYYGLTAGQPRFGTSHTHTSGGYDSLLLVSHDSSYLLLIDGPHGHDRSGQPRSQIEPRSQIEPRSQIEPRSQIEPRSQIEPRSQIEPRSQL

SEQ ID NO: 1028732 - protein, 62 aa, Homo sapiens
MIEPRSQIEPRSQIEPRSQIEPRSQIEPRSQIEPRSQIEPRSQIEPRSQIEPRSQIEPRSQL

SEQ ID NO: 1028733 - protein, 101 aa, Homo sapiens
LCLRGYTKTAERNTHTVFYSSYTILHSPQQCTRFPIFPYPLEPRSQIEPRSQIEPRSQIEPRSQIEPRSQIEPRSQIEPRSQIEPRSQIEPRSQIEPRSQL

SEQ ID NO: 1028734 - protein, 87 aa, Homo sapiens
NYAAGRGRSRYIPALLGGRGRRIKKSIEPRSQIEPRSQIEPRSQIEPRSQIEPRSQIEPRSQIEPRSQIEPRSQIEPRSQIEPRSQL

SEQ ID NO: 1028735 - protein, 69 aa, Homo sapiens
DLTTRLARPLTGCSQRRAPAALKLAMRKPRSQIEPRSQIEPRSQIEPRSQIEPRSQIEPRSQIEPRSQL

SEQ ID NO: 1028736 - protein, 51 aa, Homo sapiens
MGGLPGPVHTGLLPAKSAFSAKENTFGVGFKLRRPPAKQQCPRSQRHCSGP

SEQ ID NO: 1028737 - protein, 210 aa, Homo sapiens
EAGTDSHHPHSHLHEFHRTVVRKRAGFRTTIGGLSVLEAPQGLMPSQSACPVLSTAPGTPCDLRKHLLNMVSEEKRSPQLSAKTWRRGLRLQKRRNALFLPEGDICVVGSTSGARALIPETSKLERSGTVIAYCNLELLASSDPPVWASQSTGMTGMSYRSQPQLGFKSTPPAHSSVFHHSVKAPKEDQAQEAASRPLTSQDGWNPNIKK

SEQ ID NO: 1028738 - protein, 98 aa, Homo sapiens
AGGTYYIALHIPDSCCYGNCCQRWRFSRSYLGTVPFEFPQAAGGKLRLRQEREGPTDKVALARGLFCLLVFMRWDIPMLPKLTLNSWAQAVYPPQPPV

SEQ ID NO: 1028739 - protein, 84 aa, Homo sapiens
GERRDDAWRTWGGTLVLLRLCDKSRVHNADMLLSYSSSAHDNQRCSTTSVIAGRTLVTPPRFALHEGRMKYAPRRGMYVAVPRE

SEQ ID NO: 1028740 - protein, 98 aa, Homo sapiens; identical to SEQ ID NO: 1028738

SEQ ID NO: 1028741 - protein, 81 aa, Homo sapiens
KSICSVTMSSFALSIMLARSREVRLGAEVRLGAEVRLGAEVRLGAEVRLGAEVRLGAEVRLGAEVRLGAEVRLGAEVRLLE

SEQ ID NO: 1028742 - protein, 103 aa, Homo sapiens
MSFLCQRTFSETHVIANTTMRRSQNKIVSFAYIPRGVQQGPIQKCAWVQKCAWVQKCAWVQKCAWVQKCAWVQKCAWVQKCAWVQKCAWVQKVRLGAEVRLVE

SEQ ID NO: 1028743 - protein, 78 aa, Homo sapiens
TGPVVHGCALYIAEACVQKCAWVQKCAWVQKCAWVQKCAWVQKCAWVQKCAWVQKCAWVQKCAWVQKVRLGAEVRLVE

SEQ ID NO: 1028744 - protein, 107 aa, Homo sapiens
GALLERPKLSNAMARTLHRHIMMERERKRQEEEEVDKMMEQKRAWVEKCAWVQKCAWVQKCAWVQKCAWVQKCAWVQKCAWVQKCAWVQKCAWVQKVRLGAEVRLVE

SEQ ID NO: 1028745 - protein, 67 aa, Homo sapiens
MGEATPKKCAWVQKCAWVQKCAWVQKCAWVQKCAWVQKCAWVQKCAWVQKCAWVQKVRLGAEVRLVE

SEQ ID NO: 1028746 - protein, 88 aa, Homo sapiens
NNNQEPVSGGGSIIHDGLTQMTIWPWGALCHLKEFYYYPPLRMPIIPFLLWALTPAEAQPLNPVAFWGRSGAHSSPAPGIKPACPSRK

SEQ ID NO: 1028747 - protein, 271 aa, Homo sapiens
MAQFAFESDLHSLLQSGCTHPQCTPCCAGMRKAKEAAGPAPVTPCGAGKLSPTRLPARDSVGLNSVAKSSSKGSDHFLANLAVTAYIPHRSAAQMEVASFLLSKENQPENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVAWTTVCTCGVQLLVTSCSFAMEPLGNIYPLWLDQRGTTWFGPSVLVQFGFRANGSITDSADAPS

SEQ ID NO: 1028748 - protein, 186 aa, Homo sapiens
MAQFAFESDLHSLLQSGCTHPQCTPCCAGMRKAKEAAGPAPVTPCGAGKLSPTRLPARDSVGLNSVAKSSSKGSDHFLANLAVTAYIPHRSAAQMEVASFLLSKENQPENSQTPTKKEHQKAWALNLNGFDVEEAKILRLSGKPTKCARGLSEQTESTLQPKGHSWLQPEDLPLHSFPARPYPGCA

SEQ ID NO: 1028749 - protein, 90 aa, Homo sapiens
SAAVEQVNGNLNRRVRLSLELQQISRFPTPQIGNFEHESYNSIILLVQLQRRYLPGPRPGPVNSRIAVNSCIPTLRRPHVLATCGPLTPI

SEQ ID NO: 1028750 - protein, 105 aa, Homo sapiens
MAVPGLRYFQLSNLTVELNHNNSSIPRPFTITTKIPNITLRLTISNPFVFNMAYIFIALAPSKMAPSVIIFPTQSPIFTTSLCPIFPPLHPTPTSTRTRQFKNCR

SEQ ID NO: 1028751 - protein, 76 aa, Homo sapiens
HEADTGDTELKMSEHGLSQACMHGIRLATSCQAAGMVLLQLECTMETRWDSSSCVLMENPGDSWCKFRTEGSVCWD

SEQ ID NO: 1028752 - protein, 285 aa, Homo sapiens
MFLGHSRRCKFSEPTMTAAGGPPEPRFVTAERAVQVLRENWWPAAAPLVPIVVQGEAPAPPRPGARSVSACLAPADAWELRPRALRSSPGPAARAANPCPAMSRRKPASGGLAASSSAPARQAVLSRFFQSTGSLKSTSSSTGAADQVDPGAAAAAAAAAAAAPPAPPAPAFPPQLPPHVATEIEQKKEETMWKNDGPGENRQVKKVQQKGQEEVIMGNVVDSSEPTEMSEDQECFKVSGQMERILLQILPFLKVESRQNLCRRDLQFCQNVLILMISVFYTQQN

SEQ ID NO: 1028753 - protein, 103 aa, Homo sapiens
NSRMYLLNPGQTPKKKTLRVTNFPGFEFLVSANWDQTAGCHHQFEQHGALNHLQLKNELKGSFPPWMNRERKNTLSSHHLLLPSAKGKTSLTFTQATRLLSGS

SEQ ID NO: 1028754 - protein, 103 aa, Homo sapiens; identical to SEQ ID NO: 1028753

SEQ ID NO: 1028755 - protein, 106 aa, Homo sapiens
LTRLSARIGLSVGAGVKTLHFEEVDVITALGIILKALLVFLQAGKVELDEELGAAGLSSQWPRCSQTHVEAWSEVFESPFLEMTLGRYLHPRNVPTDGANGQPGAR

SEQ ID NO: 1028756 - protein, 62 aa, Homo sapiens
EPARLLDLLAYLDLLAYLDLLAYLDLLAYLDLLAYLDLLAYLDLLAYLDLLAYLDLLAYLTF

SEQ ID NO: 1028757 - protein, 315 aa, Homo sapiens
MRRLSQAVEGWAWGSQGLWAEVGRGAPKWACAPPSTQSLQAPPRVSTASMAHGSPTGRIEGFSNVKGSCMARSPRPSDLPTAEVMFCTPERPTKWTVDKAPGGPDRAGGLHLRPREGGSAQEGGRCSTSEDALRASPSQEHRGWHTPFIKRIKEGSVIDHIQLISVGDMIEAINGQSLLGCRHYEVARMLKELPEVVLQADSQGARRLRMIRQCKGGGRPGSGPQMGTGRVPWGTPIRGPARVGGFASAFEEKPLKAVYLREYLVQGHDWGTRGLEDKDLYGELKRGELPPKSIRMGPRTRGKEPTENALGPEMA

SEQ ID NO: 1028758 - protein, 311 aa, Homo sapiens
MRRLSQAVEGWAWGSQGLWAEVGRGAPKWACAPPGEGVGGGGVAGGGVGGGSRGGGGGLEEGEGVYGKIAEAFRLPTAEVMFCTPERPTKWTVDKAPGGPDRAGGLHLRPREGGSAQEGGRCSTSEDALRASPSQEHRGWHTPFIKRIKEGSVIDHIQLISVGDMIEAINGQSLLGCRHYEVARMLKELPEVVLQADSQGARRLRMIRQCKGGGRPGSGPQMGTGRVPWGTPIRGPARVGGFASAFEEKPLKAVYLREYLVQGHDWGTRGLEDKDLYGELKRGELPPKSIRMGPRTRGKEPTENALGPEMA

SEQ ID NO: 1028759 - protein, 230 aa, Homo sapiens
MFCTPERPTKWTVDKLLGGQIGLEDFIFAHVKGAAHRRWTVFNVGGCTSGITITGAPGLATPFIKRIKEGSVIDHIQLISVGDMIEAINGQSLLGCRHYEVARMLKELPEVVLQADSQGARRLRMIRQCKGGGRPGSGPQMGTGRVPWGTPIRGPARVGGFASAFEEKPLKAVYLREYLVQGHDWGTRGLEDKDLYGELKRGELPPKSIRMGPRTRGKEPTENALGPEMA

SEQ ID NO: 1028760 - protein, 377 aa, Homo sapiens
EDPCNTSLPWTRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 1028761 - protein, 377 aa, Homo sapiens; identical to SEQ ID NO: 1028760

SEQ ID NO: 1028762 - protein, 377 aa, Homo sapiens; identical to SEQ ID NO: 1028760

SEQ ID NO: 1028763 - protein, 178 aa, Homo sapiens
MPFPTPIILPSFFFCLQERGLIGLQFHVLGNPHIMADGKEEQVTSYMDGSSKEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 1028764 - protein, 147 aa, Homo sapiens
HAFSHPNYPPEFFFLFTRKRFNWTSVPRAGEPSHHARWQGGASHILHGCQQAKRESLEQGNSSFLKPSDLMRLISLSQEQYRKDLPPSFNDLPPVPPTHTEIQDEIRMGTQPNHIILPWPLPNLMISHFKTNHAFLTVPQSLNSFQH

SEQ ID NO: 1028765 - protein, 377 aa, Homo sapiens; identical to SEQ ID NO: 1028760

SEQ ID NO: 1028766 - protein, 81 aa, Homo sapiens
MVKDAGAEVGVWSAERLVAGKLKKDTLHPETLCIQRHFASRDTLHPETLCIQRHFASRDTLHPETLCIQRHFASRESSRSL

SEQ ID NO: 1028767 - protein, 46 aa, Homo sapiens
MPCASTSPPGLVNSIPAETSSTSPRLAENECEAYYTIANRGYRQPV

SEQ ID NO: 1028768 - protein, 111 aa, Homo sapiens
GPHAHFVPHAQFGPHAQFGPHAQFGPHAQFGPHAQFGPHAQFGPHAQFGPHAQFGPHAQFGRHAQLGRHAQRGRHAQFGPHAQFGPHAQFGPHAQFMAVRQQPECFTALEP

SEQ ID NO: 1028769 - protein, 127 aa, Homo sapiens
LSSQNDSCGGFSCFSFYLPSSSSSFPTISHSCNVASTPLWLCPGHFVPSTDPQLQTHITNFLVTAPAPITPDLGLEGRTEAQGVLSCSPLCPPRRVPSPNESRCFPRRQEKVPTPRAAEGCEEGRDE

SEQ ID NO: 1028770 - protein, 71 aa, Homo sapiens
GPYFSSSRYSSGYHRAVTTAPVTTAPVTTAPVTTAPVTTAPVTTAPVTTAPVTTAPVTTAPVTTAASYNSY

SEQ ID NO: 1028771 - protein, 82 aa, Homo sapiens
GPYFSSSRYSSGYHRAVTTAPVTTAPVTTAPVTTAPVTTAPVTTAPVTTAPVTTAPVTTAPVTTARPLCITTRQLIFGQWDA

SEQ ID NO: 1028772 - protein, 88 aa, Homo sapiens
GPYFSSSRYSSGYHRAVTTAPVTTAPVTTAPVTTAPVTTAPVTTAPVTTAPVTTAPVTTAPVTTALASASFISDAFRFISLHECLTVY

SEQ ID NO: 1028773 - protein, 97 aa, Homo sapiens
GPYFSSSRYSSGYHRQLQQLQLQQLQLQQLQLQQLQLQQLQLQQLQLQQLQLQQLQLQQLQLQQLQLQQLQLQQLQLQQLAVTTAVDNRSCSDKKRK

SEQ ID NO: 1028774 - protein, 68 aa, Homo sapiens
GPYFSSSRYSSGYHRAVTTAPVTTAPVTTAPVTTAPVTTAPVTTAPVTTAPVTTAPVTTAPVTTAPIR

SEQ ID NO: 1028775 - protein, 67 aa, Homo sapiens
FKERNPEDSHFSRISCFLGKILIGLDALKCAESLSSMDKRPKIMEEKSPSLLQCPKRLSSFPYGEVK

SEQ ID NO: 1028776 - protein, 136 aa, Homo sapiens
MASAGQDKSQSRERAGLMPRKSQASAEAEAVSEHVQGRAGARDRTEPGHSQDRVGQGNSMAGSVLGQGRAGQGDGSGRAGTGQCRAMSCRARTPPSRTSKDPLDKPGQRPGPGSGQVCARPAADEGLAKTRVKTYS

SEQ ID NO: 1028777 - protein, 181 aa, Homo sapiens
GQALKPGQALKPGQALKPGQALKPGQALKPGQALKPGQALKPGQALKPGQALKPGQALKPGQALKPGQALKPGQALKPGQALKPGQALKPGQALKPAQALKAAPGFIVFFVVSISFSPALILVISCLLLAFEFVCSCFSRSFNCDVRVLILDLSCFLLWAFSAINFPLHTALILKWSFAHL

SEQ ID NO: 1028778 - protein, 135 aa, Homo sapiens
GQALKPGQALKPGQALKPGQALKPGQALKPGQALKPGQALKPGQALKPGQALKPGQALKPGQALKPGQALKPGQALKPGQALKPGQALKPGQALKPGAACFWLYCMKALKPGKAKLLNQVAVNLPHISHAHTREQ

SEQ ID NO: 1028779 - protein, 136 aa, Homo sapiens
GQALKPGQALKPGQALKPGQALKPGQALKPGQALKPGQALKPGQALKPGQALKPGQALKPGQALKPGQALKPGQALKPGQALKPGQALKPGQASITLEAVMQESTACTLMLPSLDASSSFDEVSAFLASWLLSRLQ

SEQ ID NO: 1028780 - protein, 119 aa, Homo sapiens
GQALKPGQALKPGQALKPGQALKPGQALKPGQALKPGQALKPGQALKPGQALKPGQALKPGQALKPGQALKPGQALKPGQALKPGQALKPGQAPAAPGRSSSLAPVPILRGSQLANFLR

SEQ ID NO: 1028781 - protein, 153 aa, Homo sapiens
GQALKPGQALKPGQALKPGQALKPGQALKPGQALKPGQALKPGQALKPGQALKPGQALKPGQALKPGQALKPGQALKPGQALKPGQALKPGQALKPGQALKPGQALKPGQALKPGQALKPGQALKPPFFKDQSQVLFVISRKESINLLQMQAS

SEQ ID NO: 1028782 - protein, 97 aa, Homo sapiens
GQALKPGQALKPGQALKPGQALKPGQALKPGQALKPGQALKPGQALKPGQALKPGQALKPGQALKPGQALKPGQALKPGQALKPGQALKPGQALKPG

SEQ ID NO: 1028783 - protein, 97 aa, Homo sapiens; identical to SEQ ID NO: 1028782

SEQ ID NO: 1028784 - protein, 146 aa, Homo sapiens
GQALKPGQALKPGQALKPGQALKPGQALKPGQALKPGQALKPGQALKPGQALKPGQALKPGQALKPGQALKPGQALKPGQALKPGQALKPGQALKPGQALKPGQALKPGQALKPGQALKPGQALKPLPASTPCPHCIVAAAGITLE

SEQ ID NO: 1028785 - protein, 126 aa, Homo sapiens
GQALKPGQALKPGQALKPGQALKPGQALKPGQALKPGQALKPGQALKPGQALKPGQALKPGQALKPGQALKPGQALKPGQALKPGQALKPGQAEMGRGQQELHLYPEHSPSFDEGITSGWWVCRTS

SEQ ID NO: 1028786 - protein, 95 aa, Homo sapiens
GQALKPGQALKPGQALKPGQALKPGQALKPGQALKPGQALKPGQALKPGQALKPGQALKPGQALKPGQALKPGQALKPGQALKPGQALKPGQASC

SEQ ID NO: 1028787 - protein, 113 aa, Homo sapiens
GQALKPGQALKPGQALKPGQALKPGQALKPGQALKPGQALKPGQALKPGQALKPGQALKPGQALKPGQALKPGQALKPGQALKPGQALKPGQAAKQVGPGYIGWEPAWDTGAQ

SEQ ID NO: 1028788 - protein, 97 aa, Homo sapiens; identical to SEQ ID NO: 1028782

SEQ ID NO: 1028789 - protein, 97 aa, Homo sapiens; identical to SEQ ID NO: 1028782

SEQ ID NO: 1028790 - protein, 100 aa, Homo sapiens
GQALKPGQALKPGQALKPGQALKPGQALKPGQALKPGQALKPGQALKPGQALKPGQALKPGQALKPGQALKPGQALKPGQALKPGQALKPGQADLQSTLG

SEQ ID NO: 1028791 - protein, 97 aa, Homo sapiens; identical to SEQ ID NO: 1028782

SEQ ID NO: 1028792 - protein, 172 aa, Homo sapiens
ADPLGSTLSLGSTLFSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVCVKSSRLPASHDNTEISLLPILRPKCGLIIL

SEQ ID NO: 1028793 - protein, 144 aa, Homo sapiens
RTPRLYLVSRLYLVLSALPCLSALPCLSALPCLSALPCLSALPCLSALPCLLYLVSRLYLVSRLYLVSRLYLVSRLYLVSRLYLVSRLYLVSRLYLVSRLYLVSRLYLVSRLYLVSRLYLVSHPSTNQARPCLASETDEIGRNK

SEQ ID NO: 1028794 - protein, 128 aa, Homo sapiens
ADPLGSTLSLGSTLFSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSLFLPSLYHSLLTSTPSCHRYLY

SEQ ID NO: 1028795 - protein, 123 aa, Homo sapiens
RTPRLYLVSRLYLVLSALPCLSALPCLSALPCLSALPCLSALPCLSALPCLLYLVSRLYLVSRLYLVSRLYLVSRLYLVSRLYLVSAGFEVLGSLCGICRRMKFGAGASFWCGGGSGGGRRAK

SEQ ID NO: 1028796 - protein, 152 aa, Homo sapiens
RTPRLYLVSRLYLVLSALPCLSALPCLSALPCLSALPCLSALPCLSALPCLLYLVSRLYLVSRLYLVSRLYLVSRLYLVSRLYLVSRLYLVSRLYLVSRLYLVSRLYLVSRLYLVSRLYLVCVKSSRLPASHDNTEISLLPILRPKCGLIIL

SEQ ID NO: 1028797 - protein, 148 aa, Homo sapiens
RTPRLYLVSRLYLVLSALPCLSALPCLSALPCLSALPCLSALPCLSALPCLLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRL

SEQ ID NO: 1028798 - protein, 104 aa, Homo sapiens
RTPRLYLVSRLYLVLSALPCLSALPCLSALPCLSALPCLSALPCLSALPCLLYLVSRLYLVSRLYLVSRLYLVSRLYLVSRLYLVSLMTLTLFSPDLLGDPYKV

SEQ ID NO: 1028799 - protein, 137 aa, Homo sapiens
RTPRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSNILSCMGIVLMPVIPALREAEVGGSVSPEAEQ

SEQ ID NO: 1028800 - protein, 118 aa, Homo sapiens
ADPLGSTLSLGSTLFSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSSHACRQDRAETR

SEQ ID NO: 1028801 - protein, 129 aa, Homo sapiens
ADPLGSTLSLGSTLFSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSSHACRQDRAEKGRAEAR

SEQ ID NO: 1028802 - protein, 166 aa, Homo sapiens
RTPRLYLVSRLYLVLSALPCLSALPCLSALPCLSALPCLSALPCLSALPCLLYLVSRLYLVSRLYLVSRLYLVSRLYLVSRLYLVSRLYLVSRLYLVSRLYLVSRLYLVSRLYLVSRLYLVSRLYLVSRLYLVSRLYLVSRLYLVSSHACRQDRAEKGRAEARKSR

SEQ ID NO: 1028803 - protein, 111 aa, Homo sapiens
RTPRLYLVSRLYLVLSALPCLSALPCLSALPCLSALPCLSALPCLSALPCLLYLVSRLYLVSRLYLVSRLYLVSRLYLVSRLYLVSLKLVAYLTVKYPVVKSRLCAKLVTY

SEQ ID NO: 1028804 - protein, 73 aa, Homo sapiens
GICGSLFETATLRSGYLLPDTKAYGDRIERMLRLSLNIDPDAKVEEEPEEEPEFDSRGHLLEDTRSIRRWRKE

SEQ ID NO: 1028805 - protein, 64 aa, Homo sapiens
SSDRSLRPSADTKAYGDRIERMLRLSLNIDPDAKVEEEPEEEPEFDSRGHLLEDTRSIRRWRKE

SEQ ID NO: 1028806 - protein, 134 aa, Homo sapiens
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEFGDGTTGVGCPGVVMPTPPFWGGPAPLTRPPPS

SEQ ID NO: 1028807 - protein, 170 aa, Homo sapiens
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEFGDGTTGVGCPGMVACVQKNRSNLLDRGIHPIKNKPMGYEARLLRVPMEHLDKDSAIAALVDIKGHRNP

SEQ ID NO: 1028808 - protein, 202 aa, Homo sapiens
SAVRLGLRSRLGQPLTGRRAGLCEQARSCRFYSGSATLSKVEGTDVTGIEEVVIPKKKTWDKVAVLQALASTVNRDTTAVPYVFQDDPYLMPASSLERSFFTGKEIRENVAKFIINSYPKYFEDISYPIPCLMPEYFISAALKERIELRKVKASVDFFLQGTTVSLETTNSLDFLFYYGEPSTYHFQQTGQSEALEEENDET

SEQ ID NO: 1028809 - protein, 99 aa, Homo sapiens
PRGTGSGALPSGQKLEELKAEEPDNFSSKVVQRGREFFDSNGNFLYRFESGLGLWRCLVKHSWASITVHGTAWISGYGLATLEYEEVLSLDCVRKELCG

SEQ ID NO: 1028810 - protein, 397 aa, Homo sapiens
MVGQPQPRDDVWVSAARVIVGTIRPRVIVGTIRPRVNRSGLRVARPGTHERVTSLYTQIGWAEDVSLSSLDVIFGSAHGPWVIFGLCLLAPGDSVVISVARGGRSCLRDRWTPVVVPVAPSCSRDTPGAGDRRVSTAPRVADADPASVPSHVAALQGLQAWMNILAPVRRDRVLAGAAPVPEEGGRFARAQKTSTPASPAACQGATRTGTLWGFYGSPRVIVVGGPCRVREDLPQLVGSAKDTFGLGINNGHPFVTWTFDDGTDLRVLGIPLQFAALRIPLGQEQVTLHFINPIYRGAQAIIIGLHLNDVASLEHTKQCLSGCPERRMTPSRCASPPCRFHDGSEYPFSVCADEKDALPGGPEEIKAENGGGSISSRGKGRNSPRGERGTWPMAAGE

SEQ ID NO: 1028811 - protein, 61 aa, Homo sapiens
VRVSSHSDTAGVVFRAQAMELHEGCARGCVPFYGDSGLVANAISSPTLSLPNAISSNAISS

SEQ ID NO: 1028812 - protein, 247 aa, Homo sapiens
GRRCGRRFDSRAGGAQQPQSSRCHCSLYSRRHCRCPIPSPGACAAAPTPLGPCTRSAPACPKTCCRHQRAGGSRSRRPRGEKDGGHDGETLGPVPASQERPKEELGAAEGGRGLRSPPTPGKGADGPWRQNLGQGDRAYRRWNRTVAELVQFLLVKDKKKSPINAREMVKYVIGDLKILFPDIIAGAAEHLGYVFGFELKQFDRKHHTYILINKVKPLEEEEEEEDLEEMAQIGSVNDDPGPYLYER

SEQ ID NO: 1028813 - protein, 73 aa, Homo sapiens
PYRHSLSSALAIIGTLALEVHAYLILYLNSIRVPMNSEVPMNSEVPMNSEVPMNSEVPMNSEVPMNSEVPINS

SEQ ID NO: 1028814 - protein, 39 aa, Homo sapiens
MNSEVPMNSEVPMNSEVPMNSEVPMNSEVPMNSEVPINS

SEQ ID NO: 1028815 - protein, 83 aa, Homo sapiens
SLFIGTVDRIASIHRHFAYSSAPVLNSSIILSMHGPLELMVPMNSEVPMNSEVPMNSEVPMNSEVPMNSEVPMNSSLFIGTQA

SEQ ID NO: 1028816 - protein, 58 aa, Homo sapiens
MNSEVPMNSEVPMNSEVPMNSEVPMNSEVPMNSSLFIGTQPDQKSRIPDLSFQMVPDE

SEQ ID NO: 1028817 - protein, 80 aa, Homo sapiens
VIADSRGYTYSSGPTRVFLAAIAVKTQWCRPAPMNSEVPMNSEVPMNSEVPMNSEVPMNSEVPMNSEVPMNSSLFIGTQA

SEQ ID NO: 1028818 - protein, 70 aa, Homo sapiens
RYSSAPRYSSAPGKKMALIYDDVPSYHADGYQEKVSSVWVPMNSEVPMNSEVPMNSEVPMNSSLFIGTQA

SEQ ID NO: 1028819 - protein, 78 aa, Homo sapiens
RPPEAGARSKRTTIPDRGGRSSVKGADDSEVPMNSEVPMNSEVPMNSEVPMNSSLFIGPKPDQKSRIPDLSFQMVPDE

SEQ ID NO: 1028820 - protein, 75 aa, Homo sapiens
YSSAPPPECYSPPGSSARRIPVPMNSEVPMNSEVPMNSEVPMNSEVPMNSSLFIGTQPDQKSRIPDLSFQMVPDE

SEQ ID NO: 1028821 - protein, 91 aa, Homo sapiens
ESVPSLFIGTTTNTTTYQHHHQHTNTCTPTSTPTPAHQHPHRVPMNSELFIGTLSMSSYSVVSTGSLQCEDLADDTVADESEVPMNSERCR

SEQ ID NO: 1028822 - protein, 64 aa, Homo sapiens
MLTSGCLTNNSVYDLDVGSGHTEVPMNSEVPMNSEVPMNSEVPMNSEVPMNSEVPMNSEVPINS

SEQ ID NO: 1028823 - protein, 61 aa, Homo sapiens
MVPMNSEVPMNSEVPMNSEVPMNSEVPMNSEVPMNSSLFIGTQPDQKSRIPDLSFQMVPDE

SEQ ID NO: 1028824 - protein, 75 aa, Homo sapiens
PYRHSLSSALAIIGTLALEVHAYLILYLNSIRVPMNSEVPMNSEVPMNSEVPMNSEVPMNSEVPMNSSLFIGTQA

SEQ ID NO: 1028825 - protein, 82 aa, Homo sapiens
AIHRHRHKLHVDSIPVLISLFKVPMNSEVPMNSEVPMNSEVPMNSEVPMNSEVPMNSSLFIGTQPDQKSRIPDLSFQMVPDE

SEQ ID NO: 1028826 - protein, 83 aa, Homo sapiens
SLFIGTSLFIGTSLFIGTLCRLGMLARRSSIKLLVGVEFEVPMNSEVPMNSEVPMNSEVPMNSEVPMNSEVPMNSSLFIGTQA

SEQ ID NO: 1028827 - protein, 52 aa, Homo sapiens
MNSEVPMNSEVPMNSEVPMNSEVPMNSSLFIGTQPDQKSRIPDLSFQMVPDE

SEQ ID NO: 1028828 - protein, 158 aa, Homo sapiens
DGLASTGRSLCETQLVLYADVEELKRSVGELPSTGESLQKVQEQVHTLFSQDQAQGARLTAQDFLDRLSSLDNLKASVSQVEADLKMLRTAVDSLDAYSVKIETNENNLESAKGLLDDLTNDLDRLLVKVVKIHEKGSKNCVCQAPIAQFLLPIKGQL

SEQ ID NO: 1028829 - protein, 147 aa, Homo sapiens
DGLASTGRSLCETQLVLYADVEELKRSVGELPSTGESLQKVQEQVHTLFSQDQAQGARLTAQDFLDRLSSLDNLKASVSQVEADLKMLRTAVDSLDAYSVKIETNENNLESAKGLLDDLTNDLDRLLVKVVKIHEKGSKNCVCRARN

SEQ ID NO: 1028830 - protein, 212 aa, Homo sapiens
RDDYEKSKARVQPLRRRIPPPLFLYTAAYPAGTTAVGTPGNGTPCSQDTSFSSSRQGTPSSFGQFTPQSSQGTPYTSRGSTPYSQDSAYSSSTTSTSFKPRRSENSYQDAFSRRHFSASSASTTASTAIAATTAAIALRLPGVQWLPGLQWLPGVQWLAGVQWLAGVQWLAGVQWLAGVQWLAGVQWLECSGMIMAHCSLDHPGSSSSTSAS

SEQ ID NO: 1028831 - protein, 204 aa, Homo sapiens
RDDYEKSKARVQPLRRRIPPPLFLYTAAYPAGTTAVGTPGNGTPCSQDTSFSSSRQGTPSSFGQFTPQSSQGTPYTSRGSTPYSQDSAYSSSTTSTSFKPRRSENSYQDAFSRRHFSASSASTTASTAIAATTAAIALRLPGVQWLPGLQWLPGVQWLAGVMLCCQAGVQWQDLGSLQSSRFKLFSCLNLPSSSDYRARATTPG

SEQ ID NO: 1028832 - protein, 208 aa, Homo sapiens
RDDYEKSKARVQPLRRRIPPPLFLYTAAYPAGTTAVGTPGNGTPCSQDTSFSSSRQGTPSSFGQFTPQSSQGTPYTSRGSTPYSQDSAYSSSTTSTSFKPRRSENSYQDAFSRRHFSASSASTTASTAIAATTAAIAPPAAGSAMAARIAMAARSAMAGRSAMAGRSAMAGRSAMAGRSAMAGRSAMAGRSAMAGLGLGLESFVIFIF

SEQ ID NO: 1028833 - protein, 219 aa, Homo sapiens
RDDYEKSKARVQPLRRRIPPPLFLYTAAYPAGTTAVGTPGNGTPCSQDTSFSSSRQGTPSSFGQFTPQSSQGTPYTSRGSTPYSQDSAYSSSTTSTSFKPRRSENSYQDAFSRRHFSASSASTTASTAIAATTAAIALRLPECNGCPDCNGCPECNGWPECNGWPECNGWPECNGWPECNGWPECNGWPERNGWPECNGWPECNGWPECNGWPECNGSI

SEQ ID NO: 1028834 - protein, 104 aa, Homo sapiens
MPFPAATSLHLQPPQPPPRPSPPPLQPLRLRLPGVQWLPGLQWLPGVQWLAGVQWLAGVQWLAGVQWLAGVQWLAGVQWLECSGMIMAHCSLDHPGSSSSTSAS

SEQ ID NO: 1028835 - protein, 233 aa, Homo sapiens
RDDYEKSKARVQPLRRRIPPPLFLYTAAYPAGTTAVGTPGNGTPCSQDTSFSSSRQGTPSSFGQFTPQSSQGTPYTSRGSTPYSQDSAYSSSTTSTSFKPRRSENSYQDAFSRRHFSASSASTTASTAIAATTAAIAPPAAGSAMAARIAMAARSAMAGRSAMAGRSAMAGRSAMAGRSAMAGRSAMAGVMLCCQAGVQWQDLGSLQSSRFKLFSCLNLPSSSDYRARATTPG

SEQ ID NO: 1028836 - protein, 191 aa, Homo sapiens
RDDYEKSKARVQPLRRRIPPPLFLYTAAYPAGTTAVGTPGNGTPCSQDTSFSSSRQGTPSSFGQFTPQSSQGTPYTSRGSTPYSQDSAYSSSTTSTSFKPRRSENSYQDAFSRRHFSASSASTTASTAIAATTAAIAPPAAGSAMAARIAMAARSAMAGRSAMAGRSAMAGRSAMAGRSAMAGRSAMAGRY

SEQ ID NO: 1028837 - protein, 452 aa, Homo sapiens
MFATSGAVAAGKPYSCSECGKSFCYSSVLLRHERAHGGDGRFRCLECGERCARAADLRAHRRTHAGQTLYICSECGQSFRHSGRLDLHLGAHRQRCRTCPCRTCGRRFPHLPALLLHRRRQHLPERPRRCPLCARTFRQSALLFHQARAHPLGTTSDPAAPPHRCAQCPRAFRSGAGLRSHARIHVSRSPTRPRVSDAHQCGVCGKCFGKSSTLTRHLQTHSGEKPFKCPECGKGFLESATLVRHQRTHTGEKPYACGDCGRCFSESSTLLRHRRSHQGERPHACATCGKGFGQRSDLVVHQRIHTGEKPFACPECGRRFSDRSDLTKHRRTHTGEKPYRCELCGKRFTCVSNLNVHRRNHAGHKPHKCPECSKAFSVASKLALHRKTHLGERPAECAECGKCFSHSRSLSQHQRAHTRARTAAAVAIQSAVGTALVFEGPAEQEKPGFSVS

SEQ ID NO: 1028838 - protein, 143 aa, Homo sapiens
ARYQPCGFLTLGSLLTLFLRNVGMEVGGKAHFHEGCLHARSCLHPGRGGLLPFQFLLAALHVASCLASTPTTLSALLPCCPRITRILSSGVGAGSQGTLRLPCVHKARHCQVEHEVISKSWEPPAGRGQDGKSPGAGQLFAHG

SEQ ID NO: 1028839 - protein, 452 aa, Homo sapiens; identical to SEQ ID NO: 1028837

SEQ ID NO: 1028840 - protein, 452 aa, Homo sapiens; identical to SEQ ID NO: 1028837

SEQ ID NO: 1028841 - protein, 299 aa, Homo sapiens
MRLLLPTPPHRCAQCPRAFRSGAGLRSHARIHVSRSPTRPRVSDAHQCGVCGKCFGKSSTLTRHLQTHSGEKPFKCPECGKGFLESATLVRHQRTHTGEKPYACGDCGRCFSESSTLLRHRRSHQGERPHACATCGKGFGQRSDLVVHQRIHTGEKPFACPECGRRFSDRSDLTKHRRTHTGEKPYRCELCGKRFTCVSNLNVHRRNHAGHKPHKCPECSKAFSVASKLALHRKTHLGERPAECAECGKCFSHSRSLSQHQRAHTRARTAAAVAIQSAVGTALVFEGPAEQEKPGFSVS

SEQ ID NO: 1028842 - protein, 223 aa, Homo sapiens
MFATSGAVAAGKPYSCSECGKSFCYSSVLLRHERAHGGDGRFRCLECGERCARAADLRAHRRTHAGQTLYICSECGQSFRHSGRLDLHLGAHRQRCRTCPCRTCGRRFPHLPALLLHRRRQHLPERPLLPCCPRITRILSSGVGAGSQGTLRLPCVQEPRCWCVPLMLLCSLVFLIFLPLFCLLLSYLIPAHIFSFPDYFCCPASSGNGHRFGCRHVTSPVAS

SEQ ID NO: 1028843 - protein, 306 aa, Homo sapiens
MFATSGAVAAGKPYSCSECGKSFCYSSVLLRHERAHGGDGRFRCLECGERCARAADLRAHRRTHAGQTLYICSECARTFRQSALLFHQARAHPLGTTSDPAAPPHRCAQCPRAFRSGAGLRSHARIHVSRSPTRPRVSDAHQCGVCGKCFGKSSTLTRHLQTHSGEKPFKCPECGKGFLESATLVRHQRTHTGEKPYACGDCGRCFSESSTLLRHRRSHQGERPHACATCGKGFGQRSDLVVHQRIHTGEKPLVPEWGAVQDVGLTRPGRPGKTSVEWGTRPGATQYGQGASQRGSAGQLLNSGTG

SEQ ID NO: 1028844 - protein, 154 aa, Homo sapiens
MLFPRAPRVNVPGCLSFPCGGPQMRPLWPTAPKHMCLLPWFAPGSVRPFLGFGFPGALSSHGNGVHTRDFGRSLKDTRLSPRPPRLGLFSRTLFGFSRRVTLSRCSRRKNVVDNGKVVVGESLTSPHEKEWSSNGIRRAARAHPGTEGGAHSHR

SEQ ID NO: 1028845 - protein, 452 aa, Homo sapiens; identical to SEQ ID NO: 1028837

SEQ ID NO: 1028846 - protein, 182 aa, Homo sapiens
MWRLWTLLQREFHAAAPSAQPSGRAATCVRHLRQGFRAALRPGGAPAHPHGREALRVPRVRPPLQRPLGPHQAPAHAHGREALPLRTVRQAVHVRVQSQRASAQPCRPQATQMPRVQQGLQRRLQACTAPQDAPGRTASGVRRVRQVLQPQPLAVTASAGPHARPHRCRRCHPVRSGHCPRL

SEQ ID NO: 1028847 - protein, 175 aa, Homo sapiens
MFATSGAVAAGKPYSCSECGKSFCYSSVLLRHERAHGGDGRFRCLECGERCARAADLRAHRRTHAGQTLYICSECGQSFRHSGRLDLHLGAHRQRCRTCPCRTCGRRFPHLPALLLHRRRQHLPERPRRCPLCARTFRQSALLFHQARAHPLGTTSDPAAQTTVAQCRSFRRERV

SEQ ID NO: 1028848 - protein, 291 aa, Homo sapiens
GKGSRPRWLGRERQQRAGDPGAARARWDWGCGPGRVCGLLGHVTGAGELVPWRTGFRLGLGADPSERPPPRRPRLRSGSQRQPGAHGPSAHGSTMPALLERPKLSNAMARALHLAHSCMERERKLAGGKHSRWLTDDGNRMHEGETRSRRQDTRRWNERMSLAGRPRNKILKLEGEAFGSTRKRSPSFSCSSRKFYMRKKNRRRKEQSDLTTLTSAAYQQSLTVHTGTHLSACRGALEGHHRPRPPSWQPDRSPNQMFGTPKCFTTRHYRGAQPEAFAGTTEQWTIPGRLV

SEQ ID NO: 1028849 - protein, 243 aa, Homo sapiens
MSSALAGQGAAAASRGPRRRPRAGPRLRSGSQRQPGAHGPSAHGSTMPALLERPKLSNAMARALHLAHSCMERERKLAGGKHSRWLTDDGNRMHEGETRSRRQDTRRWNERMSLAGRPRNKILKLEGEAFGSTRKRSPSFSCSSRKFYMRKKNRRRKEQSDLTTLTSAAYQQSLTVHTGTHLSACRGALEGHHRPRPPSWQPDRSPNQMFGTPKCFTTRHYRGAQPEAFAGTTEQWTIPGRLV

SEQ ID NO: 1028850 - protein, 103 aa, Homo sapiens
MALELDHEFFLLIFHIKENKSQFVHLLREKNFLLDPIGGHRLAVGVQLACQGLLENFGICISKPEWEGKVGKYTDFIENIVFMLLGIIFMMMFTLMAIILFIV

SEQ ID NO: 1028851 - protein, 490 aa, Homo sapiens
PEQEAAGGREAGAGQELLGWSGGAAMSDSEKLNLDSIIGRLLEVQGSRPGKNVQLTENEIRGLCLKSRGDFSEPAHSSGAGGTPSRSAVTYTASTTTFCDYLSMAVSLPRATTSFWGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLISPSTPGGRRRLRVPLPSRQLGDTLTQLPNYCGEFDNAGAMMSVDETLMCSFQILKPADKNKGKYGQFSGLNLEADHHPTRIPPKPENRPPQSNLWPQMIGWIVQNIMLHAAGGHPTPQATVGEHEPRRIPTSLNMNHSKGTPRMFLPPRVPDQDLGPAAPHRRQPGSTPCPGAPDGHPGRQGTPPKNNKGARHPAPAPKTRTTHDTPTSGHNDSRHHTPP

SEQ ID NO: 1028852 - protein, 210 aa, Homo sapiens
RRTALAQRSAAGPDSTPQAVHKEELYGDFEDLETGDVHKGKSGPNTQNEDIEKEVKEEINPERRNDKCQDKSIWTKKRKLHGRCLMWKYDDRQKATYFVMDLERRKWRKRSSRLNHCSEFESIRDDVSVVRCDVGVSPTLGMVRHRSCSIVKMFPCANIVVNNIGTPRCDPECIPWDGLWSKSDGMLDNSLRLSDARIAIVEQDIGSDLR

SEQ ID NO: 1028853 - protein, 150 aa, Homo sapiens
MVHEDVSSGPLCPGTGHVDYRADDKVVPGGILQSPGEGGIVIRGVLPEKYYHVAAASTRASEVLATQENSAVPGKRLFCYWSGLDFPQIGSQAFALVDEPDLLRTPKVADRPLPVKTSSVLWLEAHGGSGHADHRTTVSGIRPLTGQSCS

SEQ ID NO: 1028854 - protein, 129 aa, Homo sapiens
MKGIGSVAISCWAMHGILHENDETGHACDSSLWCLFVGPDRNLQHSILYSSYQWQEALMKFSWVVISLQLTAEKRVPPLIDWKDGDSVMVLPTIPEEEAKKLFPKGVFTKELPSGKKYLRYTPQPKSLT

SEQ ID NO: 1028855 - protein, 203 aa, Homo sapiens
DIGRYRRTGRDEDESVVDSGSNMCKVLIPKHDTIISGCFTLLQDNLAPLPDQKFLSGEPLADKPSASCISKSTKTQHSQQKGVNILPTPPVMKINCGPLAAQMKMNMYSHLSEDRITPVCKNEDHFNKLRSIGPHFYNSKFCYSKQRDSLSEPLQLSGVHIKSEYFCGLPLAAIKEPDYGLGSENLELSVGSGRGTRARFSLY

SEQ ID NO: 1028856 - protein, 264 aa, Homo sapiens
GRIVFYCLHMIKYSLQIKENKMELKKLMGHISIIPDYRQAWKMEHKLSDILLLTICAVISGAEGWEDIEDFGETHPDFLKQYGDFENGIPVHDTIARVVSCISPAKFHECFINWMRDCHSSDDKDVIAIDGKTLRHSYDKSRRKGAIHVISAFSTMYSLVIGQIKTDEKSNEITAIPELLNMLDIKGKIITTDAMGCQKDIAEKIQKQGGDYLFAVKGNQGRVNKAFEEKFPLKELNNPTHDSYAMSEKRHGREEIRLILFAMS

SEQ ID NO: 1028857 - protein, 186 aa, Homo sapiens
MSVAEALLCNGQDDCGDSSDERGCHINECLSRKLSGCSQDCEDLKIGFKCRCRPGFRLKDDGRTCADCGRVQHHLPLQPALHQQPMASYKCLCVEGYAPRGGDPHSCKAVTDEEAVLIFANQYYLQQNLDGSNYTLLKQGLNNAVALDFDYREQMIYTDVTTQGSMIRSTLTGAMCRSYTVQASAT

SEQ ID NO: 1028858 - protein, 197 aa, Homo sapiens
CNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEAVLIFANQYYLQQNLDGSNYTLLKQGLNNAVALDFDYREQMIYTDVTTQGSMIRSTLTGAMCRSYTVQASAT

SEQ ID NO: 1028859 - protein, 83 aa, Homo sapiens
IAPPRHSATKAIAPTKAIAPTKAIAPTKAIAPTKAIAPTKAIAPTKAIAPTKAIAPTKAIAPTKARAPTKAIAPTKAIAPTGV

SEQ ID NO: 1028860 - protein, 83 aa, Homo sapiens
QSNIRGQSNIRGQSNIRGQSNILGQSNILGQSNILGSSDSPASASRVAGITGMHHKAWLILGSMSRDGVSLCGAGWSRTPDLR

SEQ ID NO: 1028861 - protein, 125 aa, Homo sapiens
QSNIRGQSNIRGQSNIRGQSNILGQSNILGQSNILGSSDSPASAYQVAGTICVRHHARLICGGDGFVPCGPNHHSFGCSDGPALGQCVCPQQSLSPSDGLSFHCCPVQRVPPLSTVWSLGVMSGL

SEQ ID NO: 1028862 - protein, 113 aa, Homo sapiens
MTGGGNNSSFVGVLFPPEVGLFSWEGGAPPGRLFPRPLGPPQRVGRQNPAPHAPQPPRPQKCVTRGPSLPQCSPNTPSALRRGPQGENGTQESVKTPPTVLGKPHGHTVVTFS

SEQ ID NO: 1028863 - protein, 113 aa, Homo sapiens; identical to SEQ ID NO: 1028862

SEQ ID NO: 1028864 - protein, 205 aa, Homo sapiens
SGLLMFSAFFVAHRPWRMATRALGYPPYLWGNWGYRGSRSPSCLPRPLLLPQLPVRRFSSSSLSRSAPKLRGRGCPQALPCVEALPLGLRMQVHRPLVPPPLGNMFCVFNHGHVLVTKGKGGHMLRSPKAASRTGPLLLQAWTPSICPTPARCRQPKFQKCFNREPPAPVPQPQAGSEAPNGKSSTRSVRRHHSWEPQSTLAHSR

SEQ ID NO: 1028865 - protein, 205 aa, Homo sapiens; identical to SEQ ID NO: 1028864

SEQ ID NO: 1028866 - protein, 137 aa, Homo sapiens
GLTVACGLTVACGLTVACGLTVACGLTVACGLTVACGLTVACGLTVACGLTVACGLTVACGLTVACGLTVACGLTVAYYESIQLYAFTKDDLKLELMFKREAEHKDLENLQPDYVVENKNPFSGEEFKPAAEMCISN

SEQ ID NO: 1028867 - protein, 86 aa, Homo sapiens
GLTVACGLTVACGLTVACGLTVACGLTVACGLTVACGLTVACGLTVACGLTVACGRSRRYKSVIDHPFPNKAKTLLTPASMTWVIR

SEQ ID NO: 1028868 - protein, 69 aa, Homo sapiens
GLTVACGLTVACGLTVACGLTVACGLTVACGLTVACGLTVACGLTVACGLTVACGIKTILANTVKSHLY

SEQ ID NO: 1028869 - protein, 92 aa, Homo sapiens
GLTVACGLTVACGLTVACGLTVACGLTVACGLTVACGLTVACGLTVACGLTVACGLTVACGLTVACGLTVACGLTVAYVILQDIDRGQLWIT

SEQ ID NO: 1028870 - protein, 69 aa, Homo sapiens
GLTVACGLTVACGLTVACGLTVACGLTVACGLTVACGLTVACGLTVACGLTVACGGIIVYPVSFSRFYP

SEQ ID NO: 1028871 - protein, 71 aa, Homo sapiens
GLTVACGLTVACGLTVACGLTVACGLTVACGLTVACGLTVACGLTVACGLTVACGFRHEVLANAYVLNGNA

SEQ ID NO: 1028872 - protein, 68 aa, Homo sapiens
GLTVACGLTVACGLTVACGLTVACGLTVACGLTVACGLTVACGLTVACGLTVACGSLHQGLLKMADIG

SEQ ID NO: 1028873 - protein, 131 aa, Homo sapiens
GLTVACGLTVACGLTVACGLTVACGLTVACGLTVACGLTVACGLTVACGLTVACGLTVACGLTVACGLTVACGLTVAYNFVFCFHIWVIRSPFNPIIPFPFKSGQLRDSFLGRGPDGYPFSRKYPHSIRII

SEQ ID NO: 1028874 - protein, 102 aa, Homo sapiens
GLTVACGLTVACGLTVACGLTVACGLTVACGLTVACGLTVACGLTVACGLTVACGFSPLLYFLGEIGNQGTAEGDHGGGGDGVLKRKKVFQDREEPGQLDPL

SEQ ID NO: 1028875 - protein, 90 aa, Homo sapiens
GLTVACGLTVACGLTVACGLTVACGLTVACGLTVACGLTVACGLTVACGLTVACGHGFFCGLPRPSLSPEGVAELLGPEAGPLDMYLQNN

SEQ ID NO: 1028876 - protein, 99 aa, Homo sapiens
MEGTKTYINSTMQESYVSQRCSQPLKLNTSFKILYRDTIQELTAPLLTTAQAKPGETQEEETNSGEEPFIETPRQDDVSRRFIPPVRMMSTGAQLHSVG

SEQ ID NO: 1028877 - protein, 124 aa, Homo sapiens
DTFCVQSSGHALSELHRMPHYADEETEAPRGLRVAQVTEPNLKDLMPGQVLPLLNPAPQGDPVCSTMSEEEAAQIPRSSVWEQDQQVRAASPMEQGQKVSCGTVPSRSVSGQVSRPNPLLAGKT

SEQ ID NO: 1028878 - protein, 133 aa, Homo sapiens
DRNLNTTFFDPPEEETPFYTNTYSDFSVTLKIDILIATRLRNNLPYCNYIYLRNKMKPVGYIGMVMSYDINWLPRVYRVSTPYIVLVGIDVDTTSIFHLRYSYIIAIPTGSKYLADSTHSTEAKDEMICMRVL

SEQ ID NO: 1028879 - protein, 255 aa, Homo sapiens
QTETSTPPSSIPPEEETPFYTNTYSDFSVTLKLIFFIATRLRNNLPYCNYIYLRNKMKPVGYIGMVMSYDINWLPRVYRVSTPYIVLVGIDVDTTSIFHLRYSSIIAIPTGSKYLADSTHSTEAKDEMICMRVLWALGIHLVLFTVGGLTGIVLANSSLDIVNYIDIVLIVVAQFHYVLSIGAVFAIIGGLHALIAPSSQAYILDQIYAKIHFTIIFIGVNLTFFPQHFLGYPECPDVTRTTPMHYIHYETSYHL

SEQ ID NO: 1028880 - protein, 526 aa, Homo sapiens
MTAEAGAPNAVLACCVAVKDRSVVKGPQWQRPGRRLVAHFGYRPRCGKLGQPVASLVVGDSEASALAAGEQPRRAPRAGRGGGVMRPVDADEAREPREEPGSPLSPAPRAGRENLASLERERALCAAAALCALPCERFALGRLHDALLCLPITDVTCATASRMLARALCAPHASPLLRCCWARARRDAAAWPRAFAAALTGLACTAPGLAVHGLGSPRICVPGLLHFGWAPPWPPLVPGHFAHVPWRQGCPALVTPLGRERPRRARRRPWGTPAQCPRARRATLASAARAWAHAARPCAALARPVRSVCRQVRGTCRPPGCLQRAPFFPRPVWQCYCRLLSRLCAVSSLLRFVRPPLSTRTAPVVVHTYSGTLPLALGTTGTHKRQGLPRFDAHNLLVSNTEYPLPPTACNPGLLATPHAAWGRIPHTLTGLCRAPRPRTAHATCRHHAAPAGVHSLRSAHHTPRFGYDNTGYLVNKRTAHFVQVQAQSGLLKLEHPSSPALPPARFRDHTPQLIVYDTHTTPTGC

SEQ ID NO: 1028881 - protein, 339 aa, Homo sapiens
MTAEAGAPNAVLACCVAVKDRSVVKGPQWQRPGRRLVAHFGYRPRCGKLGQPVASLVVGDSEASALAAGEQPRRAPRAGRGGGVMRPVDADEAREPREEPGSPLSPAPRAGRENLASLERERARAHWRARRKLLEIQSLLDAIKSEVEAEERGARAPAPRRVTEAEERVARLCAEAERKAAEAARMGRRIVDAAPADRRLRVLLSRRGRAGLERDAGGECPAWKALGVVANVTELCPPDKEIRGCLDRLKTKRAFRFVSPVFLDLRFSPPFEALNFPGNNPGENYTSALRWATGISTYIGRLRLDNKRLHYCPRKRTMGDKDSTADETRAGPRYSKSEY

SEQ ID NO: 1028882 - protein, 364 aa, Homo sapiens
RRTAEAGAPNAVLACCVAVKDRSVVKGPQWQRPGRRLVAHFGYRPRCGKLGQPVASLVVGDSEASALAAGEQPRRAPRAGRGGGVMRPVDADEAREPREEPGSPLSPAPRAGRENLASLERERARAHWRARRKLLEIQSLLDAIKSEVEAEERGARAPAPRRVTEAEERVARLCAEAERKAAEAARMGRRIVDAAPADRRLRVLLSRRGRAGLERDAGGECPAWKALGKAGEGDAQKPVPRFSRGELVFISFAVANVTELCPPDKEIRGCLDRLKTKRAFRFVSPVFLDLRFSPPFRHSIFQVTILARITLQHLDGPGYFDIHRAPSVGQQKASLMSPETNNGRQRQYRGRDKGGTKIFKERIH

SEQ ID NO: 1028883 - protein, 179 aa, Homo sapiens
MTAEAGAPNAVLACCVAVKDRSVVKGPQWQRPGRRLVAHFGYRPRCGKLGQPVASLVVGDSEASALAAGEQPRRAPRAGRGGGVMRPVDADEAREPREEPGSPLSPAPRAGRENLASLERERARAHWRARRKLLEIQSLLDAIKSEVEAEERGARALNTYGRVPEAEDDLGSTVPRKRG

SEQ ID NO: 1028884 - protein, 155 aa, Homo sapiens
YFHRETGIHWEKKVWVVSVVTPGCNQLPTWESGENYTRTINDDQGLLLSETVGGALRGLGDFVASWLGNLAEGTFFINKTEMEDFPGFPHRGLAVGYISPLPGHSASILGQLLDVMAYNKWNVFHGPRVDDPSFPYESFTFPELMRKGSYNPGEK

SEQ ID NO: 1028885 - protein, 199 aa, Homo sapiens
QYGCGWECGGHTCCVAMSGRIQARRAGLAGAGGTATGQRQSLWQEKAWRVGTRSPLGVHCIREGENWGVVGRGEQYLGRAGESSALALIQAATSTECVRQTHALANTPADPVHGCTVTQMWQHRCWSTGTHIHVHTVHTTHTRTDTQLQSPIHHANADTDTANHIRILTCPPSLCTGACKEYTLCIPTYVRRGSKQGDP

SEQ ID NO: 1028886 - protein, 87 aa, Homo sapiens
GTPASTYRKLLEGEECRLSGEGVGPVNISGVTSSVSSGYDSGSGYAVRSVEILAAASVEVWPEVAVDDTTPAAMGVSAVDGGRTCET

SEQ ID NO: 1028887 - protein, 141 aa, Homo sapiens
EDNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATWRLFDLRADQELLMYSHDIIC

SEQ ID NO: 1028888 - protein, 255 aa, Homo sapiens
MIIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREDNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATWRLFDLRADQELLMYSHDIIC

SEQ ID NO: 1028889 - protein, 99 aa, Homo sapiens
LRSGEAALAAGLGPLRKSIRAAAAAAAAAAASAAEEDSAARAPPATPAAESHRHRPRASGQELPPPVLGGGGNNEMEEIEEKVLEEKRRSVVSRLCDKI

SEQ ID NO: 1028890 - protein, 269 aa, Homo sapiens
AQFLSQTEAQPPSPVSITSAASMSDKLPYKVADIGLAAWGRKALDIAENEMPGLMRMLWSGTLASKPLNVAALQFSLAAAPCKQIEPGLGNETGGQVPIPNFEREPPPFRVQPPLGAEVQWPTCNIFSTQDHAAAAIAKAGIPVYAWKGETDEEYLWCIEQTLYFKDGPLNMILDDGGDLTNLIHTKYPHPPPGPTPEETTTGAHNPYNMMANGLNVPPINANDSLTNTPDNLYPSRESLIDGIKRATDVMIAGKVAVVAGYGDVGKGC

SEQ ID NO: 1028891 - protein, 251 aa, Homo sapiens
AQFLSQTEAQPPSPVSITSAASMSDKLPYKVADIGLAAWGRKALDIAENEMPGLMRMLWSGTLASKPLNVAALHRWLACTLTCVRLACPHLRPLVTLGAEVQWPTCNIFSTQDHAAAAIAKAGIPVYAWKGETDEEYLWCIEQTLYFKDGPPNMILDDGGDLTNLIHTKYPHPPPGPTPEETTTGAHNPYNMMANGLNVPPINANDSLTNTPDNLYPSRESLIDGIKRATDVMIAGKVAVVAGYGDVGKGC

SEQ ID NO: 1028892 - protein, 188 aa, Homo sapiens
SIRKQTLILLTNLLQEEFVKWKGSLFFRFVSTLIDSHPDIASFGEFCLAHLLLKRNPVMFFQHFIECISHFNNYEKHEKYNKFPQSEREKRLFSLNGKVKHKRDDMTHLQISSRSHSTGLNQRNSTIQLPKSGLQYSGPCLADWHPTPWTWTPVSYSQTRLEVLSSKEITLSAMRSKPDKDLLMAHER

SEQ ID NO: 1028893 - protein, 207 aa, Homo sapiens
WVQAINPSYNPPTHPSESPISPTSGNAHLRAAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGRLLGAGASRRTGQP

SEQ ID NO: 1028894 - protein, 379 aa, Homo sapiens
WVQAINPSYNPPTHPSESPISPTSGNAHLRAAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 1028895 - protein, 379 aa, Homo sapiens; identical to SEQ ID NO: 1028894

SEQ ID NO: 1028896 - protein, 215 aa, Homo sapiens
WVQAINPSYNPPTHPSESPISPTSGNAHLRAAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGKEPAFLSSSLLSPLLSSFLSLG

SEQ ID NO: 1028897 - protein, 235 aa, Homo sapiens
DHRAAVDRCAVSAAETIDRIVSTFAFLSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 1028898 - protein, 256 aa, Homo sapiens
VDVGSEQTLGFGSWTKSPKLRVSRTPRSLSQGHGEPEAAGTGAKRGGERSSTDSARFEELLLQASKELQQAQTTRPESTQIQPQPGFCIKTNSSEGTGFHQNLPLPHLSLAPRRRDRGRSCFRCYEEDPTLGSHPHEIWEQPHAEMDANGQDCSAYDVNCKQATFLPGGMPENHADYPSARGATVDLTNYGGDKGQSGANITTLAPEFCTLRACHERNRANNRSSHRRRYTSAPTQALPQGTGGLNSTPRETDKAD

SEQ ID NO: 1028899 - protein, 139 aa, Homo sapiens
MADLSGGERRRAALVSIMLGDHDLLVLDEPTNHLDVEAVAWLAGHLRHLQERGVAMLVVSHDRWFLDEICTDIWEVHNATVEAYQGGYSAYTLARVERARVAATNEAKRQNLARKELAWLRRGALPVAPNRVPSRAKCW

SEQ ID NO: 1028900 - protein, 238 aa, Homo sapiens
MINRIPSSGTPNIGLDGSEAHAAVLLWHGQAHETQLSHLAPGLLGVATFLDDAAPALEAIGLVDPLAHRVAQLFFVAAAVDRRLAHVEVGRGQCWFDRAMADLSGGERRRAALVSIMLGDHDLLVLDEPTNHLDVEAVAWLAGHLRHLQERGVAMLVVSHDRWFLDEICTDIWEVHNATVEAYQGGYSAYTLARVERARVAATNEAKRQNLARKELAWLRRGALPVAPNRVPSRAKCW

SEQ ID NO: 1028901 - protein, 84 aa, Homo sapiens
MLVVSHDRWFLDEICTDIWEVHNATVEAYQGGYSAYTLARVERARVAATNEAKRQNLARKELAWLRRGALPVAPNRVPSRAKCW

SEQ ID NO: 1028902 - protein, 139 aa, Homo sapiens; identical to SEQ ID NO: 1028899

SEQ ID NO: 1028903 - protein, 230 aa, Homo sapiens
MWDLEPVQIRFLSGTSSRTLKASSFWSHYMTRIGSKNLLMISRRCFSEDDLRDPVLLVFAHSAGHAPYCHAPDRSVLTSSGLQHLSHSHLVFPGPLCQPTGTGLYDGLDWLSHELSKRYPTRGRPLMPRKLLRAYPGMTQTPRTSSGQCPFPPTFSSPTSPTASAPAPACMFSLFLGAWRPCFSGQHRRGPPTPCLLGAYGRGFLAQAPSSTRRTTGSVVSFFFSVLGVL

SEQ ID NO: 1028904 - protein, 230 aa, Homo sapiens; identical to SEQ ID NO: 1028903

SEQ ID NO: 1028905 - protein, 543 aa, Homo sapiens
RAEPGAGRGARAGRAPGGALGCLLVPARTKTTIALLYDEESENAYDIRLKLTKEVLTIQKQDVVCVGGSHQGRNRRTVTLRRQPVGGLGLSIKGGSEHNVPVVISKIFEDQAADQTGMLFVGDAVLQVNGIHVENATHEEVVHLLRNAGDEVTITVEYLREAPAFLKLPLGSPGPSSDHSSGASSPLFDSGLHLNGNSSTTAPSSPSSPIAKDPRYEKRWLDTLSVPLSMARISRYKAGTEKLRWNAFEVLALDGVSSGILRFYTAQDGTDWLRAVSANIRELTLQNMKMANKCCSPSDQVVHMGWVNEKLQGADSSQTFRPKFLALKGPSFYVFSTPPVSTFDWVRAERTYHLCEVLFKVHKFWLTEDCWLQANLYLGLQDFDFEDQRPYCFSIVAGHGKSHVFNVELGSELAMWEKSFQRATFMEVQRTGSRTYMCSWQGEMLCFTVDFALGFTCFESKTKNVLWRFKFSQLKGSSDDGKTRVKLLFQNLDTKQIEMKELEFQDLRAVLHCIHSFIAAKVASVDPGFMDSQSLARKYMYSS

SEQ ID NO: 1028906 - protein, 308 aa, Homo sapiens
TSRAGAGRGARAGRAPGGALGCLLVPARTKTTIALLYDEESENAYDIRLKLTKEVLTIQKQDVVCVGGSHQGRNRRTVTLRRQPVGGLGLSIKGGSEHNVPVVISKIFEDQAADQTGMLFVGDAVLQVNGIHVENATHEEVVHLLRNAGDEVTITVEYLREAPAFLKLPLGSPGPSSDHSSGASSPLFDSGLHLNGNSSTTAPSSPSSPIAKDPRYEKRWLDTLSVPLSMARISRYKAGTEKLRWNAFEVLALDGVSSGILRFYTAQDGTDWLRAVSANIRELTLQNMKMANKCCSPSDLGCAYGVGK

SEQ ID NO: 1028907 - protein, 439 aa, Homo sapiens
RAEPGAGRGARAGRAPGGALGCLLVPARTKTTIALLYDEESENAYDIRLKLTKEVLTIQKQDVVCVGGSHQGRNRRTVTLRRQPVGGLGLSIKGGSEHNVPVVISKIFEDQAADQTGMLFVGDAVLQVNGIHVENATHEEVVHLLRNAGDEVTITVEYLREAPAFLKLPLGSPGPSSDHSSGASSPLFDSGLHLNGNSSTTAPSSPSSPIAKDPRYEKRWLDTLSVPLSMARISRYKAGTEKLRWNAFEVLALDGVSSGILRFYTAQDGTDWLRAVSANIRELTLQNMKMANKCCSPSDQVVHMGWVNEKLQGADSSQTFRPKFLALKGPSFYVFSTPPVSTFDWVRAERTYHLCEVLFKVHKFWLTEDCWLQANLYLGLQDFDFEDQRPYCFSIVAGHGKSHVFNVELGSELAMWEKSFQRATFMEVQRTGQIHHSQI

SEQ ID NO: 1028908 - protein, 214 aa, Homo sapiens
MAYASRCLTVDGKPLTLNFSAQDFQSYQHTAIHKFWLTEDCWLQANLYLGLQDFDFEDQRPYCFSIVAGHGKSHVFNVELGSELAMWEKSFQRATFMEVQRTGSRTYMCSWQGEMLCFTVDFALGFTCFESKTKNVLWRFKFSQLKGSSDDGKTRVKLLFQNLDTKQIEMKELEFQDLRAVLHCIHSFIAAKVASVDPGFMDSQSLARKYMYSS

SEQ ID NO: 1028909 - protein, 138 aa, Homo sapiens
MSWTFTFTHSSLMASPRTTSSPEGSIHVLMGQESGSSRLVLCLGSHQAETKVSAGLCSHLQGSLRVAGRIQSLDFIGLSSPPLSAKGCSPPPETTMFIDMVTLCPQASSRHSPYFRRRRQMGSIVVIMETDLLQISRF

SEQ ID NO: 1028910 - protein, 539 aa, Homo sapiens
MGTEGPPPPAASRGRQGCLLVPARTKTTIALLYDEESENAYDIRLKLTKEVLTIQKQDVVCVGGSHQGRNRRTVTLRRQPVGGLGLSIKGGSEHNVPVVISKIFEDQAADQTGMLFVGDAVLQVNGIHVENATHEEVVHLLRNAGDEVTITVEYLREAPAFLKLPLGSPGPSSDHSSGASSPLFDSGLHLNGNSSTTAPSSPSSPIAKDPRYEKRWLDTLSVPLSMARISRYKAGTEKLRWNAFEVLALDGVSSGILRFYTAQDGTDWLRAVSANIRELTLQNMKMANKCCSPSDQVVHMGWVNEKLQGADSSQTFRPKFLALKGPSFYVFSTPPVSTFDWVRAERTYHLCEVLFKVHKFWLTEDCWLQANLYLGLQDFDFEDQRPYCFSIVAGHGKSHVFNVELGSELAMWEKSFQRATFMEVQRTGSRTYMCSWQGEMLCFTVDFALGFTCFESKTKNVLWRFKFSQLKGSSDDGKTRVKLLFQNLDTKQIEMKELEFQDLRAVLHCIHSFIAAKVASVDPGFMDSQSLARKYMYSS

SEQ ID NO: 1028911 - protein, 140 aa, Homo sapiens
MPKEGMAGGGGHGGRVWARAPGGGPARAGPWGGRRWGSLGGGEVGEGNRAGHGGVRGEGRGRGSGGGGGSGARGGGPGGEGVGGMARGAAGGPGAPRGAAGGSSGETVEARGTRRRAGGARPCVPAPGGGRAGVPCEGRG

SEQ ID NO: 1028912 - protein, 101 aa, Homo sapiens
GEVSPGQRRGEAALSYSSAVSDKHLEEGRLYPPLNTITDVALGVAEKIVKDAYQEKTATVYPEPQNKEAFVRSQMYSTDYDQILPDCYSWPEEGGENTDQS

SEQ ID NO: 1028913 - protein, 101 aa, Homo sapiens; identical to SEQ ID NO: 1028912

SEQ ID NO: 1028914 - protein, 534 aa, Homo sapiens
MNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHLEEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWTGPFGPDPAYFASLRCGLSTRPPRPQRRFVRPLGFGGIGP

SEQ ID NO: 1028915 - protein, 868 aa, Homo sapiens
METSKIRQGMVEHVQQEEETPQSSEEVEEGLASPASGLQGSHCVFSAPASAGFHRPGVSLPSTTSHSRMSLACHQPPPVGKAPTPVDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHLEEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWTGPFGPDPAYFASLRCGLSTRPPRPQRRFVRPLGFGGIGP

SEQ ID NO: 1028916 - protein, 847 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHLEEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWTGPFGPDPAYFASLRCGLSTRPPRPQRRFVRPLGFGGIGP

SEQ ID NO: 1028917 - protein, 87 aa, Homo sapiens
VVGRLSRSPSDLGLYSLASLGCLVSPICVSFCHTGHICAVQSSGEVQIFRRGPIFRRGPIFRRGPIFRRGPIFRRGPIFRRVQSSGP

SEQ ID NO: 1028918 - protein, 368 aa, Homo sapiens
SIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQCPEHATKVALKVVTPIIISVFVLALYLHAQQVESTARLDFLWKLQATEEKEEMEELQAYNRRLLHNILPKDVAAHLLAREAHMMSSTISPVSVLAVMFASIATFSEFYVELEANNEGIE

SEQ ID NO: 1028919 - protein, 311 aa, Homo sapiens
SIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQCPEHATKVALKVVTPIIISVFVLCRCSASSSFPLKGVHSFYSYSCKNRYDYDFPWKLKSLFK

SEQ ID NO: 1028920 - protein, 250 aa, Homo sapiens
SIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQW

SEQ ID NO: 1028921 - protein, 148 aa, Homo sapiens
GPAVAGVGSSEPVVRSHGGPPGLSTTCPTAPEHATKVALKVVTPIIISVFVLALYLHAQQVESTARLDFLWKLQATEEKEEMEELQAYNRRLLHNILPKGRGRSLTGPRGAHDELYYQSCECVAVMFASIATFSEFYVELEANNEGIE

SEQ ID NO: 1028922 - protein, 56 aa, Homo sapiens
MATQAAKTQIETPTWEKESYSNFSEASEEGRLENARPGLRGALCSWIGPPGSMSVS

SEQ ID NO: 1028923 - protein, 81 aa, Homo sapiens
WHEAKILARGQDPGTRPRSWHEAKIRHEAKIRHEAKILWHEAKIPPDYVVADSAVINIKSTLFNHVLEDAYVGTKGADCIC

SEQ ID NO: 1028924 - protein, 223 aa, Homo sapiens
MCCLSSTILEEEKAQQEERMRMESRRQATVSWDSGGSDEAPPKPSRPGYPSPRSSEGFYPSPQHMVRTNHDQVTGYPGTHGITAMAGSIYPGQAISSWNKQIPGSHRPQADSNVAAQCGGLLPVLNMQEDSGHAVATPRTHEPQHPAQPHETATTKYRAGMATQRQHVTKPRKCATTRQENNTRSRMTCHRQQPSDKTRTEPRGELPAIRRTSIRRREPRHQQ

SEQ ID NO: 1028925 - protein, 722 aa, Homo sapiens
EERHLRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVLTNHDQVTGYPGTQGITAMAGSIYPGQAISLGTNRFLEVIDLRQIALWQPNVEDYYQYEHARGLGARGGHPTDSRTAAPRTAPRNCDDKIQGRDGNTATARHETQEMCDHTQENNTRSRMTCHRQQPSDKTRTEPRGELPAIRRTSIRRREPRHQQ

SEQ ID NO: 1028926 - protein, 326 aa, Homo sapiens
EERHLRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEACKCLEISVELPFDFLSVKSKLSLKK

SEQ ID NO: 1028927 - protein, 485 aa, Homo sapiens
MPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPSTWYLLYHDQVTGYPGTQGITAMAGSIYPGQAISLGTNRFLEVIDLRQIALWQPNVEDYYQYEHARGLGARGGHPTDSRTAAPRTAPRNCDDKIQGRDGNTATARHETQEMCDHTQENNTRSRMTCHRQQPSDKTRTEPRGELPAIRRTSIRRREPRHQQ

SEQ ID NO: 1028928 - protein, 311 aa, Homo sapiens
SQVNTVESSTLGCHIASPEVYDSMNLFGPKEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVRTNHDQVTGYPGTHGITAMAGSIYPGQAISSWNKQIPGSHRPQADSTVAAQCGGLLPVLNMQEDSGHAVATPRTHEPQHPAQPHETATTKYRAGMATQRQHVTKPRKCATTRQENNTRSRMTCHRQQPSDKTRTEPRGELPAIRRTSIRRREPRHQQ

SEQ ID NO: 1028929 - protein, 245 aa, Homo sapiens
MKKLPEQSLQRLQRYVGLQIASEYVKQCTILEEEKAQQEERMRMESRRQATVSWDSGGSDEAPPKPSRPGYPSPRSSEGFYPSPQHMVRTNHDQVTGYPGTHGITAMAGSIYPGQAISSWNKQIPGSHRPQADSTVAAQCGGLLPVLNMQEDSGHAVATPRTHEPQHPAQPHETATTKYRAGMATQRQHVTKPRKCATTRQENNTRSRMTCHRQQPSDKTRTEPRGELPAIRRTSIRRREPRHQQ

SEQ ID NO: 1028930 - protein, 506 aa, Homo sapiens
EERHLRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLR

SEQ ID NO: 1028931 - protein, 121 aa, Homo sapiens
KLGAGWRHFFVDARAEPRENPFYCHIYRGGAYFLPTTLSRPIRNAPTLLGLPRCIHHMKHPIICRLIHFSNSSNINNFHDLRSLRFEAKSPNSRRTLHKPGVTIWMPPTLPHIRRTRIHKI

SEQ ID NO: 1028932 - protein, 119 aa, Homo sapiens
LAVVLDQESVIRVIPASWGVGIPNDIVFTPSRCLLYLRGHQFHHNNYQYKTPCHNPIPNAPLRLIRPNHSSPTSPISPSPSCWHHYTTNRPQPQHHLLRPRRRRRPHSIPTPILIFRSP

SEQ ID NO: 1028933 - protein, 176 aa, Homo sapiens
MICCSALSPRIHLSFHRRWPDWHCISKLITRHRTTRHVLRCSSLPLCPINRSCICHHRRLHSLISPILRLHPRPNLRQNPFHYHIHRRKSNFLPTTLSRPIRNAPTLLGLPRCIHHMKHPIICRLIHFSNSSNINNFHDLRSLRFEAKSPNSRRTLHKPGVTIWMPPTLPHIRRTP

SEQ ID NO: 1028934 - protein, 122 aa, Homo sapiens
MLERPHILQRHTLVPTYILCQFTLSYPFVPGSNVCHSLIKSILRTIRTCAAGRSDYPVLDCHMKHPIICRLIHFSNSSNINNFHDLRSLRFEAKSPNSRRTLHKPGVTIWMPPTLPHIRRTP

SEQ ID NO: 1028935 - protein, 180 aa, Homo sapiens
MICCSALSPRIHLSFHRRWPDWHCISKLITRHRTTRHVLRCSSLPLCPINRSCICHHRRLHSLISPILRLHPRPNLRQNPFHYHIHRRKSNFLPTTLSRPIRNAPTLLGLPRCIHHMKHPIICRLIHFSNSSNINNFHDLRSLRFEAKSPNSRRTLHKPGVTIWMPPTLPHIRRTRIHKI

SEQ ID NO: 1028936 - protein, 180 aa, Homo sapiens; identical to SEQ ID NO: 1028935

SEQ ID NO: 1028937 - protein, 180 aa, Homo sapiens; identical to SEQ ID NO: 1028935

SEQ ID NO: 1028938 - protein, 137 aa, Homo sapiens
MGPCHTPLGPTRHLLYHLCRHTHHSAKLALIFYLSRPRNKHASFYSSSNQKNKPSFHRSCHQVFPHASNRIHNPSNSYPLQQYTLRTMNHNQYYQSILIINNHNGYSNKTRNSPPFTSESQRLPKATPLTSGLLLLT

SEQ ID NO: 1028939 - protein, 137 aa, Homo sapiens; identical to SEQ ID NO: 1028938

SEQ ID NO: 1028940 - protein, 137 aa, Homo sapiens; identical to SEQ ID NO: 1028938

SEQ ID NO: 1028941 - protein, 138 aa, Homo sapiens
RWVHAILPVGPTRHLLYHLCRHTHHSAKLALIFYLSRPRNKHASFYSSSNQKNKPSFHRSCHQVFPHASNRIHNPSNSYPLQQYTLRTMNHNQYYQSILIINNHNGYSNKTRNSPPFTSESQRLPKATPLTSGLLLLT

SEQ ID NO: 1028942 - protein, 158 aa, Homo sapiens
RSDPASRSPPLARSAGPALLRAQRVSAAVAAGAAVATLDLGKDFRFGLCSVSAVLLPAEAGPGSRASKDAAGSCGGQCALPRPGPSARRRRDQGGGGRGRDPTWRWPWIPEASPRMSTRHSPVLLTWGCTPHLGPGSSPGAGPVTWGPDLSPGGRTSH

SEQ ID NO: 1028943 - protein, 488 aa, Homo sapiens
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFYSQLIVRGVLGLGVIFGLWTLQKEVRRHFGAMVATMFCWVTAMQFHLMFYCTRTLPNVLALPVVLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRYDKREDVQPGTGMLAYTHILMEAAPGLLALYRDTHRVLASVVGTTGVSLNLTQLPPFNVHLQTKLVLLERLPRPS

SEQ ID NO: 1028944 - protein, 525 aa, Homo sapiens
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFYSQLIVRGVLGLGVIFGLWTLQKEVRRHFGAMVATMFCWVTAMQFHLMFYCTRTLPNVLALPVVLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRRIHTQHGPPRGHVRAPWGRGTGRCGGPGQDHQLSSHRYDKREDVQPGTGMLAYTHILMEAAPGLLALYRDTHRVLASVVGTTGVSLNLTQLPPFNVHLQTKLVLLERLPRPS

SEQ ID NO: 1028945 - protein, 488 aa, Homo sapiens; identical to SEQ ID NO: 1028943

SEQ ID NO: 1028946 - protein, 165 aa, Homo sapiens
AARHFFFFCFRDSLALSPRMECSGMIMAHCNVELLGSSNLPTLPNLFYMKAACSFCSDGGCIVAGCLLMAVFATKKLYFILSGLTVAVDSYFWRQLTWPEGKVLWYNTVLNKSSNWGVSFSVRAGRWVGPAATSPPPWAVEAAASPFSAAWLQGQDGAPPSHLLL

SEQ ID NO: 1028947 - protein, 488 aa, Homo sapiens; identical to SEQ ID NO: 1028943

SEQ ID NO: 1028948 - protein, 142 aa, Homo sapiens
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFYSQLIVRGVLGLGVIFGLWTLQKEVRRHFGAMVATMFCWVTVAQTRCHS

SEQ ID NO: 1028949 - protein, 488 aa, Homo sapiens; identical to SEQ ID NO: 1028943

SEQ ID NO: 1028950 - protein, 212 aa, Homo sapiens
ILACRNMARASEAVSRILEEWHKAKVETMTLDLALLRSVQHFAEAFKAKNVPLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSMVSDCLVEGGHF

SEQ ID NO: 1028951 - protein, 195 aa, Homo sapiens
LARGVVAAGAPSLEMQNDAGEFVDLYVPRKCSASNRIIGAKDHGSIQMNVAEVDKVTRQGLMASLKLMLSAGAIRRMGEIKMIPFSDLADRPDCAIDRQEVRLWGSQFECHDVEMVLGSVSQKRRWIVKALVSVFPHVDSLQRYIFGTRARRKINRSICFGHSSFLVRLLYYIIKVGQLSMKEDTQNPLIPGGND

SEQ ID NO: 1028952 - protein, 223 aa, Homo sapiens
MTPAAKICIHYATLQDPWGRAQEPADEWAWNGRVTVRGVENSLLKGRSPSPPPSRLRSGQTLPACLAAAAGAHLAQPCQAQATDAREDSLSADAKEEIRAGLESSEGGGGPERPGARGQRQTTRLEECRPDDACSTWRAVYSLVLIPKAKPLTLLWAYFCFLLAALGVTAGAHRLDGSHRSYRAKLTLRIFLAVATPWLPEGHLRNGPGPPSHKKYSETDAEP

SEQ ID NO: 1028953 - protein, 108 aa, Homo sapiens
SEQLGNSTEYQALDSHKEYTTKIPRMHTSQQLCFYENNAAADLTGHGAQVVMQAMGGARNTDEVSLHSPAAHLQLCGPVVGDRCSSAFERNHPTPFFRVIFTAAVVNL

SEQ ID NO: 1028954 - protein, 401 aa, Homo sapiens
PPRRRLFSGPTPSAALVNRTLGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKRTSAEGLNKVCVYAKKKQKTKENKKKKKKKAEKKKEKPKQKEEKRKKEKEEEEAERRTRGRTTHSQRGQTPPHGDNNRQRERPTLTQAEREGRAEKKKPQKTANTRNEATTHKAEENTEKPKKEEARHPATGGDNGAPTTHDRAEHQAAEGGATIDSHQTHSRGTRQTHHPQARRSIENTRDKHHSDGGAEEAHDTSNEGKNETQSKTGHRQKQSVTPAPHTS

SEQ ID NO: 1028955 - protein, 240 aa, Homo sapiens
MRASILLLFLLHSLGSPETSSPAGSNDTHFASRGISADGLADVLVTSKTILHRIYGHTPYCQSLFLYYARPAFKMGLSIRPPPATTPTTALLAEEITFLEPEGSFTRVFLVSGLWEKTVAEFPDAASLPSPGFSSHHTIPSMVPTGSTLPMLSWAFLPQYTNPSIPSAAINTSFNYGSRKTTYGEGRAAVVDEVLDDALDVAVPLSEIHGAQAAAFYGCFTCARNTDPAPLCSRITRPMA

SEQ ID NO: 1028956 - protein, 259 aa, Homo sapiens
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKRTSA

SEQ ID NO: 1028957 - protein, 300 aa, Homo sapiens
MWQYLPPSSSCEALLRPWTGPPESDAGAGCPRKRDPVAMGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKRTSAEGL

SEQ ID NO: 1028958 - protein, 288 aa, Homo sapiens
MGRVIRGQRKGAGSVFRAHVKHRKGAARLRAVDFAERHGYIKGIVKDIIHDPGLLAAGPFCQKGFGVSLFPGGFHGNSGYLKEKDGIREDCFHFGPPEGGKFCNIGAKVLVANVTGPKKRSPRRQLVGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKRTSA

SEQ ID NO: 1028959 - protein, 242 aa, Homo sapiens
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNRASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKRTSAEGLNKVCVYAKKK

SEQ ID NO: 1028960 - protein, 84 aa, Homo sapiens
ADSEDPNDLPKPPVFAGRRKSWHAPCYMLSTKTITSFVQDNKNKTNRLTHNKNNTAEAQLTDSFGEALHLGLAPQPGREQQKLP

SEQ ID NO: 1028961 - protein, 212 aa, Homo sapiens
MGRVIRGQRKGAGSVFRAHVKHRKGAARLRAVDFAERHGYIILEGAVSAKGIISTHCIPGGFGAAAGPCLLTGVATLPGESRYSSYTDSVRSLSQCAMRVVGEGPKRARDVSVVYRAGANSTRLRKRMRKLMWATYVRVTLRFVGPQIAHVTGYTKCRGGLGTGDVHEMALGDAHTGCDQKGLGAHWELIDGDTSEFAQPRMYSAHKRRHHE

SEQ ID NO: 1028962 - protein, 269 aa, Homo sapiens
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMNPVEHPFGGGNHQQLERSTSGKCPVGRKGSKRRGMEPETTTGARNSAATGGSEHKKKIAARKNTG

SEQ ID NO: 1028963 - protein, 272 aa, Homo sapiens
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKRTSAEGLNKVCVYAKKK

SEQ ID NO: 1028964 - protein, 303 aa, Homo sapiens
ARGEEYSGGRGGSGAGSRKAGLAGVPGRPRANRESPPGPVAMGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKRTSAEGL

SEQ ID NO: 1028965 - protein, 173 aa, Homo sapiens
MGRVIRGQRKGAGSVFRAHVKHRKGAARLRAVDFAERHGYIRASGNYATVISHNPETKKTRVKLPSGSKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKRTSA

SEQ ID NO: 1028966 - protein, 255 aa, Homo sapiens
MGRVIRGQRKGAGSVFRAHVKHRKGAVVACCADVIICLKRDGVHQGASVIGIIQSTEPGLAGRAPLQSQTGVVLSLGESREYGACTRKVVIGSLVSYGADTKGVDFNNGWPCFSSYFGWARVHEAPMSPSYIARMCDLHASVVGQLDCPRRKVLPESARLTGLVDGEGIGPLGGNTVAPKGLGRSGRQSSDVGQLFSVPNAGYNTCSQIHRPLKEALGWKRTTRVGSNKVRSPHAERFAEQGRGGLKFFHTPMCP

SEQ ID NO: 1028967 - protein, 207 aa, Homo sapiens
MGRVIRGQRKGAGSVFRAHVKHRKGAARLRAVDFAERHGYIRASSKDKSSTYLVDGECCSLRLKAGLPGIRIAFDMKATIFKRLASSSVPVGGYQCLEWYESWCCPWKGERAGEDTVSDELVPGHSRGYLVPTGNISRTNAEIQERSRVNCCPPAPSKVISSDATVACALWSLDGPGSDAPELSKPPSCKGLAGTVTRKDFKRSRRN

SEQ ID NO: 1028968 - protein, 362 aa, Homo sapiens
SGIRGCAELKTDCGEPSGRELGRTLGPCRGGGQARCQPRHRRDALLPPQGGRMPPPAKEGGRKGPRERSGKSAPGTAQGEERAKGAPATEPPKPGWALTPQGLAAMLPAQRHRHLLFGDLLEDVGAAASTFPCGSVEPGYRMPDPRPWTQSLELPAERQNRLLGVLKAAEARGRVRALRLRYTRMRAEEIALLIQRQKSARAAIRLELFLPPQLKPARIPDPLDRQEVQTSPGRGGERGGALPASAHAGPQPLSPAAEARGDHPGGERGWHKLPGVTATESVRRAPAFPHKRYNSPKNTLNPSSPILHPSLHSPNKIQPTIIIKPLLPYHTTHAAASSQFLISPGDISIIHLTDTSHNTPLL

SEQ ID NO: 1028969 - protein, 333 aa, Homo sapiens
SGIRGCAELKTDCGEPSGRELGRTLGPCRGGGQARCQPRHRRDALLPPQGGRMPPPAKEGGRKGPRERSGKSAPGTAQGEERAKGAPATEPPKPGWALTPQGLAAMLPAQRHRHLLFGDLLEDVGAAASTFPCGSVEPGYRMPDPRPWTQSLELPAERQNRLLGVLKAAEARGRVRALRLRYTRMRAEEIALLIQRQKSARAAIRLELFLPPQLKPARIPDPLDRQERRRVETILEENVDGTIFPGLTATESVRRAPAFPHKRYNSPKNTLNPSSPILHPSLHSPNKIQPTIIIKPLLPYHTTHAAASSQFLISPGDISIIHLTDTSHNTPLL

SEQ ID NO: 1028970 - protein, 88 aa, Homo sapiens
RCCSGVLEDPEHDPSMHACPAGRRVFTTCGACLPVQVPSTREHRADLQISLSWSLVDFRGSSSTTSIAMHCLAAVDVYSPTCPVHAHP

SEQ ID NO: 1028971 - protein, 88 aa, Homo sapiens; identical to SEQ ID NO: 1028970

SEQ ID NO: 1028972 - protein, 77 aa, Homo sapiens
TPHVPTTQFMAPARRVFTTAVHASLYKFLGHVSSVLTSQSRKHGAWFRGSSSTTSIAMHCLAAVDVYSPTCPVHAHP

SEQ ID NO: 1028973 - protein, 88 aa, Homo sapiens; identical to SEQ ID NO: 1028970

SEQ ID NO: 1028974 - protein, 162 aa, Homo sapiens
MEPGRRVFTTGGACLPVQVPSTREHRADLQISLSWSLVDFRGSSSTTSIAMHCLAAPHLFTTAMHTFLYMLLEYMSSALMTQACIHACRGRRVFTYVPGACASLVYIVPVQIYSRAIQLLTLPISLTTIILLIDKWSHGQTCILPIVVRCMPCHMYKFRRHQ

SEQ ID NO: 1028975 - protein, 85 aa, Homo sapiens
IASDAGSRSTCIHLRARCMRIPSVHSSCADLQLSNPVADSPNIVKNNHTAYRQMEPWSDVYSTHRRQVHAMPPVQVPSTSVSIQC

SEQ ID NO: 1028976 - protein, 88 aa, Homo sapiens; identical to SEQ ID NO: 1028970

SEQ ID NO: 1028977 - protein, 88 aa, Homo sapiens; identical to SEQ ID NO: 1028970

SEQ ID NO: 1028978 - protein, 180 aa, Homo sapiens
RCCSGVLEDPEHDPSMHACPAGRRVFTTCGACLPVQVPSTREHRADLQISLSWSLVDFRGSSSTTSIAMHCLAAPHLFTTAMHTFLYMLLEYMSSALMTQACIHACRGRRVFTYVPGACASLVYIVPVQIYSRAIQLLTLPISLTTIILLIDKWSHGQTCILPIVVRCMPCHMYKFRRHQ

SEQ ID NO: 1028979 - protein, 107 aa, Homo sapiens
STTPGQTSRDKLRQHGRTALTTRDRKHGAWSTCIHLRARCMRIPSVHSSCADLQLSNPVADSPNIVKNNHTAYRQMEPWSDVYSTHRRQVHAMPPVQVPSTSVSIQC

SEQ ID NO: 1028980 - protein, 95 aa, Homo sapiens
LEDPEHGASHRTSVSVSWSTCIHLRARCMRIPSVHSSCADLQLSNPVADSPNIVKNNHTAYRQMEPWSDVYSTHRRQVHAMPPVQVPSTSVSIQC

SEQ ID NO: 1028981 - protein, 74 aa, Homo sapiens
PPRSNHPIHASSSTCIHHCGAYLPVQVPWTRELRADLPITQTWSLVDVYSPLAVHASLYKFRRHVSTVLTSKYR

SEQ ID NO: 1028982 - protein, 282 aa, Homo sapiens
VESSKRVQMKLCGTEAGASTYLPKQKPSKQPCKQKMLFLRVDVADTSGHVWAKAPGFSPHPLNWVPENGSSLNIWNSSTNKKGLIETNVSVLSLCFPELEYQHVLYLPTAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 1028983 - protein, 331 aa, Homo sapiens
ETTYLKPTFCDNCAGFLWGVIKQGYRCKDIRILLLMLRFTDKGYIKSVSSGLHQVRRMLASLGMLSVLAPEDRTDMCDKKALHEFGCETPGEERKVKDFLTQDVLSTDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 1028984 - protein, 214 aa, Homo sapiens
LIEPARVDTPWIRSLIDRDVSRTDRTNKFYEGPENPGLGLLNDILLTYCMYHFDLGYVQGMSDLLSPILYVIQNEVDAFWCFCGFMELVQGNFEESQETMKRQGRLLLLLRVLDPLLCDFLDSQDSGSLCFCFRWLLIWFKREFPFPDVLRLWEVLWTGLPGPNLHLLVACAILDMERDTLMLCGFGSNEILKHEAQSGRSGGGGGMPTELNNT

SEQ ID NO: 1028985 - protein, 94 aa, Homo sapiens
MDSQDSGSLCFCFRWLLIWFKREFPFPDVLRLWEVLWTGLPGPNLHLLVACAILDMERDTLMLCGFGSNEILKHEAQSGRSGGGGGMPTELNNT

SEQ ID NO: 1028986 - protein, 170 aa, Homo sapiens
GLQTQLVPLSSPVASLDNFSNLFGADLHVEKGQVPSSDQHLSQRCHFPKAPPWSVCKALLPRSNPATSLSGTSKPNSGGDFNSVTKSQPHCELNSFVLTGHSPVLWMMSEHDLADVVQIAVEDLSPDHPGTELWDILEHVVTDEDEPALKRQRLEINCQVPSIKSFLYSI

SEQ ID NO: 1028987 - protein, 137 aa, Homo sapiens
GLQTQLVPLSSPVASLDNFSNLFGADLHVEKGQVPSSDQHLSQRCHFPKAPPWSVCKALLPRSNPATSLSGTSKPNSGGDFNSVTKSQPHCELNSFVLTGHSPVLWMMSEHDLADVVQIAVEDLSPDHPGTELWDSR

SEQ ID NO: 1028988 - protein, 121 aa, Homo sapiens
SSSDHPQISRVGACRCFLFWRAFRFLILLLWEKESFPMPLRLWGPSFPLPLTLGVALGLGLGFFFSFLYGLFLTILYDFFFSNCHSHYRHHLPLGNLHRCRNLSPGMVPHPPLLSSSRKRI

SEQ ID NO: 1028989 - protein, 145 aa, Homo sapiens
SSSDHPQISRVGACRCFLFWRAFRFLILLLWEKESFPMPLRLWGPSFPLPLTLGVALGLGLGFFFSFLYGLFLTILYDFFFSNCHSHYRHHLPLGNLHRCRNLSPGMVPHPPLLVLPSLPTSSMSISLCLEAALDAACRCWRTFL

SEQ ID NO: 1028990 - protein, 54 aa, Homo sapiens
RAEPGTLEVSHRYPQRRHFCPNPVKTSAFSVVFSIVIPFLYVSGHSLARTLLLY

SEQ ID NO: 1028991 - protein, 137 aa, Homo sapiens
RPDTACEKPDRKGILPLSTTLSPQRFFFLGLILTAVMACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 1028992 - protein, 137 aa, Homo sapiens; identical to SEQ ID NO: 1028991

SEQ ID NO: 1028993 - protein, 137 aa, Homo sapiens; identical to SEQ ID NO: 1028991

SEQ ID NO: 1028994 - protein, 112 aa, Homo sapiens
RPDTACEKPDRKGILPLSTTLSPQRFFFLGLILTAVMACPLEKALDVMVSTFHKYSGKEGDKFKLNKSELKELLTRELPSFLGKRTDEATWTATGTTRWTSKSTVSSCPASP

SEQ ID NO: 1028995 - protein, 104 aa, Homo sapiens
MLKASVDRIPPEAENILFIEMFTRRQVAIQNRVASNIGISQSTFSVKVLNLFSRSRRKTNKRKSKHSAMLRNKETRHRMFIGLLNTTRKLGRRGREFSSSSWRP

SEQ ID NO: 1028996 - protein, 311 aa, Homo sapiens
RVARTRLPWLLDADLRGRRAEWGASVCWTSTMQRLELGFGPVAATRGSGCGLSAVGPTTVLCPIAHAMCGVSPCHEPGGWNVFHLLMMLLLLVASDQPVPNEKSPCQPNPCHGAAPCRVLPEGGAQCECPLGREGTFCQTASGQDGSGPFLADFNGFSHLELRGLHTFARDLGEKMALEVRVPGTRPQRPPALTNGAEDGRQGGLRVAGHCGDLRLEFPLRPGPGGSGHQEQGRQSPWEPGPGSHWRRNGAWCLRVGRGPRVWGSPGSAHRPKPEGSRLRRGRSDPRSWPCCCRVSGFDGANHGGRRPWRY

SEQ ID NO: 1028997 - protein, 225 aa, Homo sapiens
MLEWLFIKFTGARLVELSEKLMKEAFVSNLNGTTVLEITQGWCFPAFCILCRGFLIIFSQYLCSFSPTWKTRFLTDFVVLIVPMVATLTIWASFILLELLGVIIFGAGLLYQIYRRRTCYARLPFLKILEKFLNISLESEYNPAISCFRVITSAFTAIAILAVDFPLFPRRFAKTELYGTGAMDFEQVVLWFWGCNGLSRGQEEKIYGRGQIALLYKLNVLWFGH

SEQ ID NO: 1028998 - protein, 277 aa, Homo sapiens
MTVDTKAAGKGRSDVHQWCIALMDSRGVTVARGARNDATGTFDIFYTGPPAGLIRSSVMRFGVASTCPISPFQVTGLWLGTYSPRVQPPLRSQLRGPDRYTYAQGGQPDLRAPDRPLVGCQMGLDVTSLRPFDLVIPFTIKKGEITGEVLAALHGRGVRRARTYLADKQKIGSRDRGGMHPARLACTRWTSGYDNMHIPGSPLQFYVDYVNCGHVTAYGPGLTHGVVNKPATFTVKTKDAGEGGLSLAIEGPSKQKSGALTTGWDMQRVLPACACRG

SEQ ID NO: 1028999 - protein, 267 aa, Homo sapiens
MLVPPVDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKGLGPCSAGGTEFIPSSCCSGHLCCCLSSTRTLCYFHAARTIEFTLGYRCTKPASQIGCSGPGIHHTSLVGYSGKWRCGLVMKWAGPVTQITLGWGHESQLMGVFPRAYWPQNRQWANYDLRTQLESGLILNGKVQDTPVVYTALSGVLA

SEQ ID NO: 1029000 - protein, 302 aa, Homo sapiens
MRKETPLIWEFGSAESRGLPANDRAYLCHVELGGIALDTRVDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKGLGPCSAGGTEFIPSSCCSGHLCCCLSSTRTLCYFHAARTIEFTLGYRCTKPASQIGCSGPGIHHTSLVGYSGKWRCGLVMKWAGPVTQITLGWGHESQLMGVFPRAYWPQNRQWANYDLRTQLESGLILNGKVQDTPVVYTALSGVLA

SEQ ID NO: 1029001 - protein, 367 aa, Homo sapiens
SQVTLRAYRMRATAGKQDGAIEAFSREVELRFPRERGGGSEVHHVGFAAGAESPAGVSLSLGWSWNRGDAEGNPTCPSVPRGPGVESSPKCARLHGTAVEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKGLGPCSAGGTEFIPSSCCSGHLCCCLSSTRTLCYFHAARTIEFTLGYRCTKPASQIGCSGPGIHHTSLVGYSGKWRCGLVMKWAGPVTQITLGWGHESQLMGVFPRAYWPQNRQWANYDLRTQLESGLILNGKVQDTPVVYTALSGVLA

SEQ ID NO: 1029002 - protein, 257 aa, Homo sapiens
SQVTLRAYRMRATAGKQDGAIEAFSREVELRFPRERGGGSEVHHVGFAAGAESPAGVSLSLGWSWNRGDAEGNPTCPSVPRGPGVESSPKCARLHGTAVEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKGLGPCSAGGTEFITLFFFFFFFFFKRRESESAGGRQHAH

SEQ ID NO: 1029003 - protein, 292 aa, Homo sapiens
MRKETPRAYARGRWRNAMTVVRSWRLRVSGADGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKGLGPCSAGGTEFIPSSCCSGHLCCCLSSTRTLCYFHAARTIEFTLGYRCTKPASQIGCSGPGIHHTSLVGYSGKWRCGLVMKWAGPVTQITLGWGHESQLMGVFPRAYWPQNRQWANYDLRTQLESGLILNGKVQDTPVVYTALSGVLA

SEQ ID NO: 1029004 - protein, 35 aa, Homo sapiens
WRRRNSHHPADERLHHEVVLEVADGIADLGPTLVD

SEQ ID NO: 1029005 - protein, 261 aa, Homo sapiens
MAAVGRVGSFGSSPPGLSSTYTGGPLGKEIASGNGGAAAGTTRTGRTFGACILSEVSTRSRSKLPAGKNRATAGLKMEPGKNKLNSDDSNIPGDISRTSFQDKGKQALGNYSATLTLCQCLQDQGMNQNKDVTVRILGWSTYIHKGPPLNFPPGMPLSLKDTLGYCVVVDIVKGLWTCFVSFFYTNMGKCGLENMADKREKSLLRGTGHNMEQKLVRDFQELCESQEEELPGFSPEKKYCVARRQRMTVYVYLWVRIHLAH

SEQ ID NO: 1029006 - protein, 224 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIVSTIPNYSEKDTKQDPPPSGCEESKIVEMSEDAYTVLDPTLGLETYTALQPSSSSKLHRLGCARTTHRVTAKDGQWLRHDTFRDARGSLLPPSSPMRNESIRGHPHGKHPNWQREKRRGHSPVTHPFQQTTYTKSATA

SEQ ID NO: 1029007 - protein, 351 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPLHRPSPAVKSSPMEMSKTEALTQAFRRSIGVRIKEEDGDHRKGRVVEIQIDRQPAGTGSKVAQTDPSRPQPCETIYQLGTNMIESLSQGPGVPGPGTVITIDKGARCQISKLGLLLHTPPADYKAMGSQTKFVQCPDGELPEYAKEGGRTTVSPGTEIGRSFNCAPPGLSWRLLLQGDTRGTIQVRTSREQINAKVDLSGPRKGQAGRITPLECWSSGRVPCWTLKTSPFLKRARGSSCGRPGSWASGDSAN

SEQ ID NO: 1029008 - protein, 136 aa, Homo sapiens
IVRLQLDYRTDLPSPRQGSQECQRVSLPIRDVVLGGLITHVRLDARRECPEGDRLIIGDVTCLPIQCPVLGELVCRQDVSIDHVLHKGEVHQVLPISHHELHLAVPGCLDERWVPTAGPLGRKCHEGGWLWFGHSS

SEQ ID NO: 1029009 - protein, 121 aa, Homo sapiens
MAASSATPVPAESDCAGQMLVSAVHGLYFGGAAAVAEPDHLMGSGHHGRANSGLGGVPASRRGLGSRIYARLFDAIRWTNPRRTYSAIWTGAWPSSVHAPATERPCGVGPLSCRSQVEVWP

SEQ ID NO: 1029010 - protein, 170 aa, Homo sapiens
MAPKRAKRRTVAEGGSSSVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKKFLEELLTTQCDRFSQEEIKNMWAAFPPDVGGNVDYKNICYVITHGDAKDQE

SEQ ID NO: 1029011 - protein, 67 aa, Homo sapiens
KGTRNPIATPLVSPLSSLEELLTTQCDRFSQEEIKNMWAAFPPDVGGNVDYKNICYVITHGDAKDQE

SEQ ID NO: 1029012 - protein, 166 aa, Homo sapiens
MAPKRAKRRTVEGGSSSVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKKFLEELLTTQCDRFSQEEIKNMWAAFPPDVGGNVDYKNILAWFRESQAK

SEQ ID NO: 1029013 - protein, 153 aa, Homo sapiens
MENRLCDGLKDPINVKNEELDAMMKEASGPINFTVFLTMFGEKLKGELECPGSKAPAAFSQTLQGPISFMCPLTPTGADPEDVITGAFKVLDPEGKGTIKKKFLEELLTTQCDRFSQEEIKNMWAAFPPDVGGNVDYKNICYVITHGDAKDQE

SEQ ID NO: 1029014 - protein, 169 aa, Homo sapiens
MAPKRAKRRTVEGGSSSVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKKFLEELLTTQCDRFSQEEIKNMWAAFPPDVGGNVDYKNICYVITHGDAKDQE

SEQ ID NO: 1029015 - protein, 170 aa, Homo sapiens; identical to SEQ ID NO: 1029010

SEQ ID NO: 1029016 - protein, 256 aa, Homo sapiens
MPGMMEKGPELLGKNRSANGSAKSPAGGGGSGASSTNGGLHYSEPESGCSSDDEHDVGMRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTGQPVTSQNGLGKK

SEQ ID NO: 1029017 - protein, 174 aa, Homo sapiens
MPGMMEKGPELLGKNRSANGSAKSPAGGGGSGASSTNGGLHYSEPESGCSSDDEHDVGMRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMVW

SEQ ID NO: 1029018 - protein, 198 aa, Homo sapiens
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTGQPVTSQNGLGKK

SEQ ID NO: 1029019 - protein, 256 aa, Homo sapiens; identical to SEQ ID NO: 1029016

SEQ ID NO: 1029020 - protein, 289 aa, Homo sapiens
MPGMMEKGPELLGKNRSANGSAKSPAGGGGSGASSTNGGLHYSEPESGCSSDDEHDVGMRVGAEYQARIPEFDPGVETRSCYVSQAGLKLRGSSHPPSLAPKVLLIIGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTGQPVTSQNGLGKK

SEQ ID NO: 1029021 - protein, 119 aa, Homo sapiens
MPGMMEKGPELLGKNRSANGSAKSPAGGGGSGASSTNGGLHYSEPESGCSSDDEHDVGMRVGAEYQARIPEFDPGSPAVTRFQPVQGLGESSAYGGALAGASRSGARFLLPTLPETLLS

SEQ ID NO: 1029022 - protein, 95 aa, Homo sapiens
RHEGGRHTSLASQLWEVRPQDSGCSCQGDIFSPTSQVPASSANPACGLPVYFSPNRLPGGHEISACAGIGREFRIWRRPCWSLSEWSAFPSPHPA

SEQ ID NO: 1029023 - protein, 119 aa, Homo sapiens; identical to SEQ ID NO: 1029021

SEQ ID NO: 1029024 - protein, 217 aa, Homo sapiens
SVRFSSLVTSPQASSDSPPGFTSVIASPKITSHSTPSFTSSITTTETTSHSTPSFTSSITTTETTSHSTPSFTSSITTTETTSHSTPSFTSPPPRPPHTVLPASLLQSPPLRPPHMETTSRSSPSFTSLITITGSTSHSTPSFTSSITITETTSHSTPSITSSVTTAERTSHSTPSYAFSIATSETPSHTVPSFTSLITTTESTSHSRPTNLASLIT

SEQ ID NO: 1029025 - protein, 147 aa, Homo sapiens
SVRFSSLVTSPQASSESPPGFTSVIASPKITSHSTPSFTSSITTTETTSHSTPSFTSSITTTETTSHSTPSFTSSITTTETTSHSTPSFTSSITTTETTSHSTPSFTSSITTTETTSHSTPSFTSSDHHHRDHLTQYSQLHFFDHHL

SEQ ID NO: 1029026 - protein, 1104 aa, Homo sapiens
LSTTPVASSEASTLSTSPVDTSTPVTNSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTLSEGSIPITIMHVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCSLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETTDPNSEASGNDDIILRHGAEKSGSEEIPVRLSLVEHFPIESLPWELNVPIVSTGNKPRTYQGERGETAVLGDSQIETRGRSNGLVMISG

SEQ ID NO: 1029027 - protein, 1013 aa, Homo sapiens
MVTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSLSSSTIYSTVSTSTTAITSHFTTSETAVTPTPVTPSSLSTDIPTTSLRTLTPLSLNTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029028 - protein, 1350 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSIRTTETTSHSTPSFTSSIIATETTSHSTPSYTSLIPTTETTSHSTPSFTSSITTTETTSHSTPSFTSSITTTDSIVTTETTSHSTPSFTSSISTTETTSHSTPSFTSSITITETTSHSTPSYTTSITTTETPSSSTPSFTSSITTTETTSHSTPSFTSSISTTETTSHSTPSFTSSITTTETTSHGTPSFTSSITTTETPSHSTPSFTSLITTTETTSHSTPSFTSSITTTETTSHSTPSFTSLITTTETPSHSTPSFTSSITTTETTSHSTTSFTSSITTTETTSHSTPSFSSSITTTETPLHSTPGLPSWVTTTKTTSHITPGLTSSITTTETTSHSTPGFTSSNHHHWTTSHSTPSLSSSTIYSTVSTSTTAITSHFTTSETAVTPTPVTPSSLSTDIPTTSLRTLTPLSLNTSTSLTTTTDFPSIPTDISTLPTPTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029029 - protein, 1359 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSIRTTETTSHSTPSFTSSIIATETTSHSTPSYTSLIPTTETTSHSTPSFTSSITTTETTSHSTPSFTSSITTTDSIVTTETTSHSTPSFTSSISTTETTSHSTPSFTSSITITETTSHSTPSYTTSITTTETPSSSTPSFTSSITTTETTSHSTPSFTSSISTTETTSHSTPSFTSSITTTETTSHSTPSFTSSITTTETPSHSTPSFTSLITTTDSIVTTETTYDHLTQYSQLHFFDHHHRDHLTQYSQLHFFDHHHRDPVTQYSQLHFFDHHHRDHLTQYYQLHFFDHHHRDHLTQYSQLQFFNHHHRDPLTQYSWPTFVGHHHQDHLTHYSWPHFFNHHHWDYLTQYSRLHFFNHHHWTTSHSTPSLSSSTIYSTVSTSTTAITSHFTTSETAVTPTPVTPSSLSTDIPTTSLRTLTPLSLNTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029030 - protein, 1176 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSIRTTETTSHSTPSFTSSIIATETTSHSTPSYTSLIHCHRDRLTTVNASPTARSSPPRPHPTVLPASLLQSAPLRPHPTVLPASLLRSPSLRPPHTVLPASFTSSITTTETTSHSTPSFSSSITTTETPLHSTPGLPSWVTTTKTTSHITPGLTSSITTTETTSHSTPGFTSSNHHHWTTSHSTPSLSSSTIYSTVSTSTTAITSHFTTSETAVTPTPVTPSSLSTDIPTTSLRTLTPLSLNTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029031 - protein, 1185 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSIRTTETTSHSTPSFTSSIIATETTSHSTPSYTSLIHCHRDRLTTVNATTLDHLTQYSQLHFFDHHHRDHLTQYSQLHFFDHHHRDPVTQYSQLHFFDHHHRDHLTQYYQLHFFDHHHRDHLTQYSQLQFFNHHHRDPLTQYSWPTFVGHHHQDHLTHYSWPHFFNHHHWDYLTQYSRLHFFNHHHWTTSHSTPSLSSSTIYSTVSTSTTAITSHFTTSETAVTPTPVTPSSLSTDIPTTSLRTLTPLSLNTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029032 - protein, 1038 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSLSSSTIYSTVSTSTTAITSHFTTSETAVTPTPVTPSSLSTDIPTTSLRTLTPLSLNTSTSLTTTTDFPSIPTDISTLPTPTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029033 - protein, 1038 aa, Homo sapiens; identical to SEQ ID NO: 1029032

SEQ ID NO: 1029034 - protein, 980 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSLSSSTIYSTVSTSTTAITSHFTTSETAVTPTPVTPSSLSTDIPTTSLRTLTPLSLNTSTSLTTTTDFPSIPTDISTLPTPTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRSWDQDRKWFETWDEEVVGTFSNWGFEDDGTDKDTNFYVALENVDTTMKVHIKRPEMTSSSV

SEQ ID NO: 1029035 - protein, 533 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSLSSSTIYSTVSTSTTAITSHFTTSETAVTPTPVTPSSLSTDIPTTSLRTLTPLSLNTSTSLTTTTDFPSIPTDISTLPTPTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTSHSTPATLPQSPAPDGT

SEQ ID NO: 1029036 - protein, 208 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETPSSSTPSFTSSITTTDSIVTTETTSHSTPSFTSSISTTETTSHSTPSFTSSITITETTSHSTPSYTTSITTTETTSHLPPNFTSLITASQKD

SEQ ID NO: 1029037 - protein, 148 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETTSHSTPSFTSSDHHHRDHLTQYSQLHFFDHHL

SEQ ID NO: 1029038 - protein, 218 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSPPPRPPHTVLPASLLQSPPLRPPHMETTSRSSPSFTSLITITGSTSHSTPSFTSSITITETTSHSTPSITSSVTTAERTSHSTPSYAFSIATSETPSHTVPSFTSLITTTESTSHSRPTNLASLIT

SEQ ID NO: 1029039 - protein, 670 aa, Homo sapiens
LSTTPVASSEASTLSTSPVDTSTPVTNSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTLSEGSIPITIMHVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSITTTETTSHSTPSFTSSITRSSPPRPHPTVLPASLLQSAPLRPHPTVLPASLLRSPSLRPPHTVLPATLPQSPPPSYLTPSSQLHVFDHRLPERL

SEQ ID NO: 1029040 - protein, 1038 aa, Homo sapiens; identical to SEQ ID NO: 1029032

SEQ ID NO: 1029041 - protein, 1038 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSLSSSTIYSTVSTSTTAITSHFTTSETAVTPTPVTPSSLSTDIPTTSLRTLTPSSVGTSTSLTTTTDFPSIPTDISTLPTPTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029042 - protein, 1299 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETPSSSTPSFTSSITTTDSIVTTETTSHSTPSFTSSISTTETTSHSTPSFTSSITITETTSHSTPSYTTSITTTETPSSSTPSFTSSITTTETTSHSTPSFTSSISTTETTSHSTPSFTSSITTTETTSHGTPSFTSSITTTETPSHSTPSFTSLITTTETTSHSTPSFTSSITTTETTSHSTPSFTSLITTTETPSHSTPSFTSSITTTETTSHSTTSFTSSITTTETTSHSTPSFSSSITTTETPLHSTPGLPSWVTTTKTTSHITPGLTSSITTTETTSHSTPGFTSSNHHHWTTSHSTPSLSSSTIYSTVSTSTTAITSHFTTSETAVTPTPVTPSSLSTDIPTTSLRTLTPLSLNTSTSLTTTTDFPSIPTDISTLPTPTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029043 - protein, 1261 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSIRITTTETTSHSTPSFTSLITTSETPSHSTPSFTSSITTTETPSSSTPSFTSSITTTETTSHSTPSFTSSISTTETTSHSTPSFTSSITTTETTSHGTPSFTSSITTTETPSHSTPSFTSLITTTETTSHSTPSFTSSITTTETTSHSTPSFTSLITTTETPSHSTPSFTSSITTTETTSHSTTSFTSSITTTETTSHSTPSFSSSITTTETPLHSTPGLPSWVTTTKTTSHITPGLTSSITTTETTSHSTPGFTSSNHHHWTTSHSTPSLSSSTIYSTVSTSTTAITSHFTTSETAVTPTPVTPSSLSTDIPTTSLRTLTPLSLNTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029044 - protein, 1279 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSPPPRPPHTVLPASLLQSPPLRPPHMETTSRSSPSFTSLITITGSTSHSTPSFTSSITITETTSHSTPSYTTSITTTETPSSSTPSFTSSITTTETTSHSTPSFTSSISTTETTSHSTPSFTSSITTTETTSHSTPSFTSSITTTETPSHSTPSFTSLITTTETTSHSTPSFTSSITTTETTSHSTPSFTSLITTTETPSHSTPSFTSSITTTETTSHSTTSFTSSITTTETTSHSTPSFSSSITTTETPLHSTPGLPSWVTTTKTTSHITPGLTSSITTTETTSHSTPGFTSSNHHHWTTSHSTPSLSSSTIYSTVSTSTTAITSHFTTSETAVTPTPVTPSSLSTDIPTTSLRTLTPLSLNTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029045 - protein, 999 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSLSSSTIYSTVSTSTTAITSHFTTSETAVTPTPVTPSSLSTDIPTTSLRTLTPLSLNTSTSLTTTTDFPSIPTDISTLPTPTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDAEDFCRHAGLHLQGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029046 - protein, 794 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSLSSSTIYSTVSTSTTAITSHFTTSETAVTPTPVTPSSLSTDIPTTSLRTLTPSSVGSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 1029047 - protein, 1070 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSFTSSITTTETTSHSTPSLSSSTIYSTVSTSTTAITSHFTTSETAVTPTPVTPSSLSTDIPTTSLRTLTPLSLNTSTSLTTTTDFPSIPTDISTLPTPTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVRGYRGGPQGTLPASIPESLPDPQPGQGGGWARIGSDLPVSPTSG

SEQ ID NO: 1029048 - protein, 131 aa, Homo sapiens
WGASFTSLITTSETPSHSTPSFTSSISTTETTSHSTPSFTSSITTTETTSHSTPSFTSSITTTETTSHSTPSFTSSITTTETTSHSTPSFTSSITTTETTSHSTPSFTSSIMITTTETTFHSTNEGEAVIL

SEQ ID NO: 1029049 - protein, 173 aa, Homo sapiens
RPLRSPKRKKKQISNFTNNYHFYFISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKGHVILRQSQET

SEQ ID NO: 1029050 - protein, 258 aa, Homo sapiens
GLLFLRASWAVGAASSSGSAVQRGHGSLLRSAEHSALNPAAALVWLTLTACLPADPTAAAPACPGLLPGLLLIFQDLIRYGKTKCGEPQRPAACRAFDVPKRYFSHFYFISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKGHVILRQSQET

SEQ ID NO: 1029051 - protein, 170 aa, Homo sapiens
PARLGTAAGKPGEVIFLHFYFISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKGHVILRQSQET

SEQ ID NO: 1029052 - protein, 144 aa, Homo sapiens
RPLRSPKRKKKQISNFTNNYHFYFISVLWNGFLLWCLTQSLFLGAPFPSWLHGLLRILGAAQFQGGELALSAFLVLVFLWLHSLRRLFECLYVSVFSNVMIHVVQYCFGLVYYVLVGALLNLCSWEHLFQAGFMVCSEFSGRHS

SEQ ID NO: 1029053 - protein, 182 aa, Homo sapiens
KKKQQTQKAKLARYSLAFNQAAGKMADIQTERAYQKQPTIFQNKKRVLLGETGKEKLPRYYKNIGLGFKTPKEAIEGTYIDKKCPFTGNVSIRGRILSGVVTKMKMQRTIVIRRDYLHYIRKYNRFEKRHKNMSVHLSPCFRDVQIGDIVTVGECRPLSKTVRFNVLKVTKAAGTKKQFQKF

SEQ ID NO: 1029054 - protein, 194 aa, Homo sapiens
KKKQQTQKAKLARYSLAFNQAAGKMADIQTERAYQKQPTIFQNKKRVLLGETGKEKLPRYYKNIGLGFKTPKEAIEGTYIDKKCPFTGNVSIRGRILSGVVTKMKMQRTIVIRRDYLHYIRKYNRFEKRHKNMSVHLSPCFRDVQIGDIVTVGECRPLSKTVRFNVLKVTKAASTKKQFQVTKAAGTKKQFQKF

SEQ ID NO: 1029055 - protein, 77 aa, Homo sapiens
VRLGTCQTLNYVHYIRKYNRFEKRHKNMSVHLSPCFRDVQIGDIVTVGECRPLSKTVRFNVLKVTKAAGTKKQFQKF

SEQ ID NO: 1029056 - protein, 182 aa, Homo sapiens; identical to SEQ ID NO: 1029053

SEQ ID NO: 1029057 - protein, 323 aa, Homo sapiens
KKKQQTQKAKLARYSLAFNQAAGKMADIQTERAYQKQPTIFQNKKRVLLGETGKEKLPRYYKNIGLGFKTPKEAIEGTYIDKKCPFTGNVSIRGRILSGVVTKMKMQRTIVIRRDYLHYIRKYNRFEKRHKNMSVHLSPCFRDVQIGDIVTVGECRPLSKTVRFNVLKVTNGLARQHKDKQCYHESNIERWTHRCPKYHNKENKSLIVPQYPHKQSRKTKQKNRANQIDKGNGSRKQSGYYEKSNAGVDTATTQTERSDQQTNRWPKCRRRPQYEEDAANKNEKNCTEAKTGNTDQRQKETDQTNSTNQSRALKKKRSITREN

SEQ ID NO: 1029058 - protein, 123 aa, Homo sapiens
SVATASIRSRRLPTLCRALPLPPSPFSRALWAQGGSTRPRGWFGAGLAPADQTLSPSQSPDFAEELRSLEPSPSPGPQEEDGEVALVLLGRPSPGAVGPEDVALCSSRRPVRPGRRGLGPVPS

SEQ ID NO: 1029059 - protein, 105 aa, Homo sapiens
MVGGGQGRWPLCTGPLLQGWGVRGHRGVLLTPVFPLLPWGLLCEEGQGRLPGQSCLATGVGERLKMCLNPGRGLKAPENTRQVSSGPQHLPRGPHLSLTWPYSTG

SEQ ID NO: 1029060 - protein, 947 aa, Homo sapiens
YALADRDEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAAWGEAGHQHPRGCQGPRWQPPRPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 1029061 - protein, 979 aa, Homo sapiens
YALADRDEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAAWGEAGHQHPRGCQGPRWQPPRPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLPLSGKKFDYRAFAALPSSRPVYDIQSPDFAEELRSLEPSPSPGPQEEDGEVALVLLGRPSPGAVGPEDVALCSSRRPVRPGRRGLGPVPS

SEQ ID NO: 1029062 - protein, 695 aa, Homo sapiens
YALADRDEEEASTEEEDKEGAVVSAPSVKGVSFDQANNLLIEPARIEEEELTLTSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAAWGEAGHQHPRGCQGPRWQPPRPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 1029063 - protein, 954 aa, Homo sapiens
YALADRDEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAAWGEAGHQHPRGCQGPRWQPPRPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 1029064 - protein, 407 aa, Homo sapiens
YALADRDEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLASKASGWAPSVVKAMSVPTKSRVPLARLYQDTPARCT

SEQ ID NO: 1029065 - protein, 954 aa, Homo sapiens; identical to SEQ ID NO: 1029063

SEQ ID NO: 1029066 - protein, 863 aa, Homo sapiens
YALADRDEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTDPGSERARRAGCHAPRSSQCPAPALPGAVAAGAEGPGTPGPTGTVHPEGTWGEAGHQHPRGCQGPRWQPPRPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 1029067 - protein, 719 aa, Homo sapiens
SKLPQPEAVVALLQGMQPDGEGPVAPGGWHNGPHAPWAPRAQKEEEEEEEGSPQEEEEEEEEENRAEEEEPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAAWGEAGHQHPRGCQGPRWQPPRPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 1029068 - protein, 1121 aa, Homo sapiens
YALADRDEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAAWGEAGHQHPRGCQGPRWQPPRPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQVQSPPQNPTRPWALTDSTGSSMSLHEAAAESTYMTMEVLQCHQGQAGEPRHKTRSTLDGVHDRTNAGAHCQERTAQPRQALTDTKRRRAGHACRSRRRQQEPAGPHTAEGIQHHGTRGQQRQEADGTATHSDGLEARHKNRGNHEPRTTAKTMTETTKRQQDGKNNNRRHQRAEANMRRPHTSRTAKRETTHTPGHATEHHTTDTRTHETNDTKKPSTRKQHGDKSRRSHRGNKTPNNEPRKETEREKKQESNEHTSGRQERKTTQDRDKRARGESRRPRKGDDRNSKNREHTEKQEENKKAKGHHTRERNRDSNEKEEPQKGEQGDQNDQYGEDSQTQEKRQRTSSDKGQRKTNRDSNKATQDQERKPGNRQQQRETAAGETEEREKKERRSRDRERTEEQASRDKANREQRERGRKRKERTEETAERQQNNNERKNQEKSTGGTRQQEARRQNTTK

SEQ ID NO: 1029069 - protein, 180 aa, Homo sapiens
ADVAELLLYTFLVVLSDAAVGLEVSGWCCGFPRAFRCVFTRGLNPEIGGSSPVWTFPPRSKIVPNSPSPEKVFPGEFRRIKLAEGVRQSHELRVLKQLGGESRAPRKKWLQKAIVETTTSVKWQKSTDPPKWELIKRTERHQMAAKLERLREKDKHHCKKCGRTKNPKSLLTRLKLTNLF

SEQ ID NO: 1029070 - protein, 181 aa, Homo sapiens
AALWASAQALRRTTSRPLVDWDRKWRVLGLSVFLARGSGVSCADRSEGSWPTAPSRSLPPPSTLSVVEKMVGRNSAIAAGVCGALFIGYCIYFDRKRRSDPNFKNRLRERRKKQKLAKERAGLSKLPDLKDAEAVQKFFLEEIQLGEELLAQVFIGRNGYCKVPEKVNLPNQGHTVNMRRA

SEQ ID NO: 1029071 - protein, 185 aa, Homo sapiens
KKQAQYIIGRYREFVRGSVPGPRPSGVSCADRSEGSWPTAPSRSLPPPSTLSVVEKMVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPNN

SEQ ID NO: 1029072 - protein, 198 aa, Homo sapiens
AALWASAQALRRTTSRPLVDWDRKWRVLGLSVFLARGSGVSCADRSEGSWPTAPSRSLPPPSTLSVVEKMVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPNN

SEQ ID NO: 1029073 - protein, 350 aa, Homo sapiens
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 1029074 - protein, 314 aa, Homo sapiens
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGSIHQTCG

SEQ ID NO: 1029075 - protein, 315 aa, Homo sapiens
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIIARRLNPSPTVFTLLVSLYLH

SEQ ID NO: 1029076 - protein, 93 aa, Homo sapiens
GGAAQSAITQRESYEVRGRGFPRQLALEASASRAGLDNSRSANGWFDEAQNGKEYEISKIDVKDMEAPLNKDARTSKQDQISRHRTGNPRDLR

SEQ ID NO: 1029077 - protein, 329 aa, Homo sapiens
AARRKAPLRREKVTRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 1029078 - protein, 163 aa, Homo sapiens [sequence omitted]

SEQ ID NO: 1029079 - protein, 315 aa, Homo sapiens
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGRCTLERGL

SEQ ID NO: 1029080 - protein, 350 aa, Homo sapiens; identical to SEQ ID NO: 1029073

SEQ ID NO: 1029081 - protein, 300 aa, Homo sapiens
MSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 1029082 - protein, 148 aa, Homo sapiens
MGPKSRCRSHYKGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 1029083 - protein, 1171 aa, Homo sapiens
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQVYNDFLDIMKEFKSQSIDTPGVISRVSQLFKGHPDLIMGFNTFLPPGYKIEVQTNDMVNVTTPGQVHQIPTHGIQPQPQPPPQHPSQPSAQSAPAPAQPAPQPPPAKVSKPSQLQAHTPASQQTPPLPPYASPRSPPVQPHTPVTISLGTAPSLQNNQPVEFNHAINYVNKIKNRFQGQPDIYKAFLEILHTYQKEQRNAKEAGGNYTPALTEQEVYAQVARLFKNQEDLLSEFGQFLPDANSSVLLSKTTAEKVDSVRNDHGGTVKKPQLNNKPQRPSQNGCQIRRHPTGTTPPVKKKPKLLNLKDSSMADASKHGGGTESLFFDKVRKALRSAEAYENFLRCLVIFNQEVISRAELVQLVSPFLGKFPELFNWFKNFLGYKESVHLETYPKERATEGIAMEIDYASCKRLGSSYRALPKSYQQPKCTGRTPLCKEVLNDTWVSFPSWSEDSTFVSSKKTQYEEHIYRCEDERFELDVVLETNLATIRVLEAIQKKLSRLSAEEQAKFRLDNTLGGTSEVIHRKALQRIYADKAADIIDGLRKNPSIAVPIVLKRLKMKEEEWREAQRGFNKVWREQNEKYYLKSLDHQGINFKQNDTKVLRSKSLLNEIESIYDERQEQATEENAGVPVGPHLSLAYEDKQILEDAAALIIHHVKRQTGIQKEDKYKIKQIMHHFIPDLLFAQRGDLSDVEEEEEEEMDVDEATGAVKKHNGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSGALLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKL

SEQ ID NO: 1029084 - protein, 1171 aa, Homo sapiens
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQVYNDFLDIMKEFKSQSIDTPGVISRVSQLFKGHPDLIMGFNTFLPPGYKIEVQTNDMVNVTTPGQVHQIPTHGIQPQPQPPPQHPSQPSAQSAPAPAQPAPQPPPAKVSKPSQLQAHTPASQQTPPLPPYASPRSPPVQPHTPVTISLGTAPSLQNNQPVEFNHAINYVNKIKNRFQGQPDIYKAFLEILHTYQKEQRNAKEAGGNYTPALTEQEVYAQVARLFKNQEDLLSEFGQFLPDANSSVLLSKTTAEKVDSVRNDHGGTVKKPQLNNKPQRPSQNGCQIRRHPTGTTPPVKKKPKLLNLKDSSMADASKHGGGTESLFFDKVRKALRSAEAYENFLRCLVIFNQEVISRAELVQLVSPFLGKFPELFNWFKNFLGYKESVHLETYPKERATEGIAMEIDYASCKRLGSSYRALPKSYQQPKCTGRTPLCKEVLNDTWVSFPSWSEDSTFVSSKKTQYEEHIYRCEDERFELDVVLETNLATIRVLEAIQKKLSRLSAEEQAKFRLDNTLGGTSEVIHRKALQRIYADKAADIIDGLRKNPSIAVPIVLKRLKMKEEEWREAQRGFNKVWREQNEKYYLKSLDHQGINFKQNDTKVLRSKSLLNEIESIYDERQEQATEENAGVPVGPHLSLAYEDKQILEDAAALIIHHVKRQTGIQKEDKYKIKQIMHHFIPDLLFAQRGDLSDVEEEEEEEMDVDEATGAVKKHNGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSRSLLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKL

SEQ ID NO: 1029085 - protein, 373 aa, Homo sapiens
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQVYNDFLDIMKEFKSQSIDTPGVISRVSQLFKGHPDLIMGFNTFLPPGYKIEVQTNDMVNVTTPGQVHQIPTHGIQPQPQPPPQHPSQPSAQSAPAPAQPAPQPPPAKVSKPSQLQAHTPASQQTPPLPPYASPRSPPVQPHTPVTISLGTAPSLQNNQPVEFNHAINYVNKIKNRFQGQPDIYKAFLEILHTYQKEQRNAKEAGGNYTPALTEHVPREMAAETSKWLMGEG

SEQ ID NO: 1029086 - protein, 102 aa, Homo sapiens
MKRRLDDQESPVYAAQQRRIPGSTEAFPHQHRVLAPAPPVYEAVSETMQSATGIQYSVTPSYQVSWSQPRDKNEGREIVVLGNYKTFFNTVLDIKNLLSMCK

SEQ ID NO: 1029087 - protein, 1186 aa, Homo sapiens
MIDFAAACIPEHEHRMKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQVYNDFLDIMKEFKSQSIDTPGVISRVSQLFKGHPDLIMGFNTFLPPGYKIEVQTNDMVNVTTPGQVHQIPTHGIQPQPQPPPQHPSQPSAQSAPAPAQPAPQPPPAKVSKPSQLQAHTPASQQTPPLPPYASPRSPPVQPHTPVTISLGTAPSLQNNQPVEFNHAINYVNKIKNRFQGQPDIYKAFLEILHTYQKEQRNAKEAGGNYTPALTEQEVYAQVARLFKNQEDLLSEFGQFLPDANSSVLLSKTTAEKVDSVRNDHGGTVKKPQLNNKPQRPSQNGCQIRRHPTGTTPPVKKKPKLLNLKDSSMADASKHGGGTESLFFDKVRKALRSAEAYENFLRCLVIFNQEVISRAELVQLVSPFLGKFPELFNWFKNFLGYKESVHLETYPKERATEGIAMEIDYASCKRLGSSYRALPKSYQQPKCTGRTPLCKEVLNDTWVSFPSWSEDSTFVSSKKTQYEEHIYRCEDERFELDVVLETNLATIRVLEAIQKKLSRLSAEEQAKFRLDNTLGGTSEVIHRKALQRIYADKAADIIDGLRKNPSIAVPIVLKRLKMKEEEWREAQRGFNKVWREQNEKYYLKSLDHQGINFKQNDTKVLRSKSLLNEIESIYDERQEQATEENAGVPVGPHLSLAYEDKQILEDAAALIIHHVKRQTGIQKEDKYKIKQIMHHFIPDLLFAQRGDLSDVEEEEEEEMDVDEATGAVKKHNGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSGALLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKL

SEQ ID NO: 1029088 - protein, 1013 aa, Homo sapiens
VLDEVRRKLYGMPTDFGFCVKVKTWPGLAPGYKIEVQTNDMVNVTTPGQVHQIPTHGIQPQPQPPPQHPSQPSAQSAPAPAQPAPQPPPAKVSKPSQLQAHTPASQQTPPLPPYASPRSPPVQPHTPVTISLGTAPSLQNNQPVEFNHAINYVNKIKNRFQGQPDIYKAFLEILHTYQKEQRNAKEAGGNYTPALTEQEVYAQVARLFKNQEDLLSEFGQFLPDANSSVLLSKTTAEKVDSVRNDHGGTVKKPQLNNKPQRPSQNGCQIRRHPTGTTPPVKKKPKLLNLKDSSMADASKHGGGTESLFFDKVRKALRSAEAYENFLRCLVIFNQEVISRAELVQLVSPFLGKFPELFNWFKNFLGYKESVHLETYPKERATEGIAMEIDYASCKRLGSSYRALPKSYQQPKCTGRTPLCKEVLNDTWVSFPSWSEDSTFVSSKKTQYEEHIYRCEDERFELDVVLETNLATIRVLEAIQKKLSRLSAEEQAKFRLDNTLGGTSEVIHRKALQRIYADKAADIIDGLRKNPSIAVPIVLKRLKMKEEEWREAQRGFNKVWREQNEKYYLKSLDHQGINFKQNDTKVLRSKSLLNEIESIYDERQEQATEENAGVPVGPHLSLAYEDKQILEDAAALIIHHVKRQTGIQKEDKYKIKQIMHHFIPDLLFAQRGDLSDVEEEEEEEMDVDEATGAVKKHNGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSGALLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKL

SEQ ID NO: 1029089 - protein, 156 aa, Homo sapiens
MKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVVFSSFSWVKKFIFSRKYWLQLVGCGGTTSNLRY

SEQ ID NO: 1029090 - protein, 734 aa, Homo sapiens
LEDRIRAACIPEHEHRMKRRLDDQESPVYAAQQRRIPGSTEAFPHQHRVLAPAPPVYEAVSETMQSATGIQYSVTPSYQVSAMPQSSGSHGPAIAAVHSSHHHPTAVQPHGGQVVQSHAHPAPPVAPVQGQQQFQRLKVEDALSYLDQVKLQFGSQPQVYNDFLDIMKEFKSQSIDTPGVISRVSQLFKGHPDLIMGFNTFLPPGYKIEVQTNDMVNVTTPGQVHQIPTHGIQPQPQPPPQHPSQPSAQSAPAPAQPAPQPPPAKVSKPSQLQAHTPASQQTPPLPPYASPRSPPVQPHTPVTISLGTAPSLQNNQPVEFNHAINYVNKIKNRFQGQPDIYKAFLEILHTYQKEQRNAKEAGGNYTPALTEQEVYAQVARLFKNQEDLLSEFGQFLPDANSSVLLSKTTAEKVDSVRNDHGGTVKKPQLNNKPQRPSQNGCQIRRHPTGTTPPVKKKPKLLNLKDSSMADASKHGGGTESLFFDKVRKALRSAEAYENFLRCLVIFNQEVISRAELVQLVSPFLGKFPELFNWFKNFLGYKESVHLETYPKERATEGIAMEIDYASCKRLGSSYRALPKSYQQPKCTGRTPLCKEVLNDTWVSFPSWSEDSTFVSSKKTQYEEHIYRCEDERFELDVVLETNLATIRVLEAIQKKLSRLSAEEQAKFRLDNTLGGTSEVIHRKALQRIYADKAADIIDGLRKNPSIAVPIVLKRYMSKCALSALVYFTTGSVSH

SEQ ID NO: 1029091 - protein, 430 aa, Homo sapiens
MLSLLDISQNTFVSLSHQRQEQATEENAGVPVGPHLSLAYEDKQILEDAAALIIHHVKRQTGIQKEDKYKIKQIMHHFIPDLLFAQRGDLSDVEEEEEEEMDVDEATGAVKKHNGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSGALLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKL

SEQ ID NO: 1029092 - protein, 368 aa, Homo sapiens
TKEKERTRTLLLGTSWLVITAEEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRWVLANEILLGSRTQPPGCHASVSQCSPGPSAGARGWGLRDGCGPCLDRKIQVHDLVVEQLANMGCCQALEVIPRTLIQNCGASTIRLLTSLRAKHTQENCETWGVNGETGTLVDMKELGIWEPLAVKLQTYKTAVETAVLLLRIDDIVSGHKKKGDDQSPARRGSLMLARSECYARLQFNCDRTSRVSPFPAARVPGTLWTSLFRRDQVGGQPPDPFLFRAQIFPKTLTC

SEQ ID NO: 1029093 - protein, 236 aa, Homo sapiens
MSHQEFGFILSVCFSKEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSPARRGSLMLARSECYARLQFNCDRTSRVSPFPAARVPGTLWTSLFRRDQVGGQPPDPFLFRAQIFPKTLTC

SEQ ID NO: 1029094 - protein, 400 aa, Homo sapiens
SSLACNIALDAVKMVQFEENGRKEIDIKKYARVEKIPGGIIEDSCVLRGVMINKDVTHPRMRRYINEPSSLCCWIAVLPGKYQKKKGRQKGPELDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSPARRGSLMLARSECYARLQFNCDRTS

SEQ ID NO: 1029095 - protein, 427 aa, Homo sapiens
SSLACNIALDAVKMVQFEENGRKEIDIKKYARVEKIPGGIIEDSCVLRGVMINKDVTHPRMRRYINEPSSLCCWIAVLPGKYQKKKGRQKGPELDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEALEVIPRTLIQNCGASTIRLLTSLRAKHTQENCETWGVNGETGTLVDMKELGIWEPLAVKLQTYKTAVETAVLLLRIDDIVSGHKKKGDDQSPARRGSLMLARSECYARLQFNCDRTSRVSPFPAARVPGTLWTSLFRRDQVGGQPPDPFLFRAQIFPKTLTC

SEQ ID NO: 1029096 - protein, 296 aa, Homo sapiens
GLLGGEIRNKGRKEKFSPCKVGDRKILVTGKTVSQRKKIQFNQEEERLKNRTVFVGNLPVTCNKKKLKSSFKEYAQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 1029097 - protein, 333 aa, Homo sapiens
EKKQGSIKEENKGASSTRPPNNAGEPRPCTPQGENPQMQREAWSYKKSQTAKRNSHLVLSSEAILRTRRHQSSLKKKFKSPEKRDKEGETVLLELPVTCNKKKLKSSFKEYAQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 1029098 - protein, 333 aa, Homo sapiens; identical to SEQ ID NO: 1029097

SEQ ID NO: 1029099 - protein, 278 aa, Homo sapiens
GLLGGEIRNKGRKEKFSPCKVGDRKILVTGKTVSQRKKIQFNQEEERLKNRTVFVGNLPVTCNKKKLKSSFKEYAQIESVRFRSLIPAEGTLSKKLAAIKRKIHPDQKNINAYVVFKEESAATQALKRNGAQIADGFRVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 1029100 - protein, 158 aa, Homo sapiens
GLLGGEIRNKGRKEKFSPCKVGDRKILVTGKTVSQRKKIQFNQEEERLKNRTVFVGNLPVTCNKKKLKSSFKEYAQIESVRFRSLIPAEGTLSKKLAAIKRKIHPDQKNINAYVVFKEESAATQALKRNGAQIADGFRIRVDLASETSSRIQILFILL

SEQ ID NO: 1029101 - protein, 130 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQVMYFSLDPIANFKTIIIYK

SEQ ID NO: 1029102 - protein, 826 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSSCTEISCSILSTMLQEAVRQTGTYLGGSVLVAGKVIVGSDLVKNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 1029103 - protein, 836 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPPTMGTRFKHETKTPSPRPTSNTGDQISA

SEQ ID NO: 1029104 - protein, 581 aa, Homo sapiens
MILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 1029105 - protein, 819 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 1029106 - protein, 809 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRHLHHTEVYSENRQFRDPQGS

SEQ ID NO: 1029107 - protein, 819 aa, Homo sapiens; identical to SEQ ID NO: 1029105

SEQ ID NO: 1029108 - protein, 819 aa, Homo sapiens; identical to SEQ ID NO: 1029105

SEQ ID NO: 1029109 - protein, 819 aa, Homo sapiens; identical to SEQ ID NO: 1029105

SEQ ID NO: 1029110 - protein, 691 aa, Homo sapiens [sequence omitted]

SEQ ID NO: 1029111 - protein, 71 aa, Homo sapiens
HREIHINEYATLDGGERWEDKKKTPPNYTLTKNQKKNQKKWIMKVWGDKSSESPEINVKCLMQWFPNLSAH

SEQ ID NO: 1029112 - protein, 288 aa, Homo sapiens
MLNAGQGERHRARRAWPKPTRSKTVDRCNAAVRMELCRLLQNEAVMVTEDEVEKYSEVREGRPRRILEQAEKKATDAEAMMWPPCNRCIQLVEEELDLGPRSPGYLALQKLEEAEKAAELRARDGMTVIEYRAMKDEEKMELLEMQLKEAKHIAEDSDRKYEEVARKLVILEGELERSEERAEVAESPGDLEEELKIVTNNLKSLEAQADKYSTKEDKYEEEIKLLEEKLKEAETRAEFAERSVAKLEKHIDDLEEHLGRAQEENVEIHQTLDQYLLELNNLLRAAPP

SEQ ID NO: 1029113 - protein, 290 aa, Homo sapiens
MLNAGQGERHRARRAWPKPTRSKTVDRCNAAVRMELCRLLQNEAVMVTEDEVEKYSEVREGRPRRILEQAEKKATDAEAMMWPPCNRCIQLVEEELDLGPRSPGYLALQKLEEAEKAAELRARDGMTVIEYRAMKDEEKMELLEMQLKEAKHIAEDSDRKYEEVARKLVILEGELERSEERAEVAESEPDSWRRNFEPWTMALKFPDWASEEEYSTKEDNYEEEIKLLEEKLKEAETRAEFAERSVAKLEKHIDDLEEHLGRAQEENVEIHQTLDQYLLELNNLLRAAPP

SEQ ID NO: 1029114 - protein, 138 aa, Homo sapiens
PRRAPAPIGAPRGAGEGRSAPLDGRRHFRLSLSLGGSAPNFSPEAEVVANGSMSLRSGGRRRADPGADGEASRDDGATSSVSALKRLERSQWTDKMDLRFGFERLKEPGEKTGWLINMHPVSTRSFSHPGIWLQPFWS

SEQ ID NO: 1029115 - protein, 77 aa, Homo sapiens
MDLRFGFERLKEPGEKTGWLINMHPTEILDEDKRLGSAVDYYFIQDDGSRFKEAPDCDKLKPTFMGVHVSSVTVREG

SEQ ID NO: 1029116 - protein, 2286 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCTCAGDFALTIHTQVFMEQIGIFRNIAQHYGMSYLLETLEWLLQKNPQLGH

SEQ ID NO: 1029117 - protein, 2257 aa, Homo sapiens [sequence omitted]

SEQ ID NO: 1029118 - protein, 2286 aa, Homo sapiens; identical to SEQ ID NO: 1029116

SEQ ID NO: 1029119 - protein, 2326 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMVCFFPGIQILPTLVLVNPAAFDFLLQRVEKTLRHALEEEEKVPVEQVTNFEEVCDEIKSKLASLKDVPSRIECPLIYHLDVGAMYPNIILTNRLQVRLYFPCQSRSSLCPALVLSHPSQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 1029120 - protein, 2550 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRCHPLWEGVLLIEGSYPWPLIWKAKSKTGSIGLPLVLMAEPETLCGEFSIVYCLYHCGGPAWSLATVQCTASDLPVARGTSHRVFLTRATFRCDQRYITGISSQLYLSMMCEASALRCQELSVCCRGRGWGSGAISLRRAWLRAATRITHQRWFMLGNACCVPGGGPSTSHSASVPTSAQGRGAVIVCFSDKETEVRGAAFVVIPQMKEGILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLKEADTPKCEEKERRKRELRSSATGRSCRGASEQRLGDAPSCRVVVHGVQACRMEGVCLKCRGVKETSMPVYCSCAGDFALTIHTQVFMEQIGIFRNIAQHYGMSYLLETLEWLLQKNPQLGH

SEQ ID NO: 1029121 - protein, 263 aa, Homo sapiens
CVSDCSTHGPFCHLALSPWASPVPVTQHYRNEVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLKEADTPKCEEKERRKRELRSSATGRSCRGASEQRLGDAPSCRVVVHGVQACRMEGVCLKCRGVKETSMPVYCSCAGDFALTIHTQVFMEQIGIFRNIAQHYGMSYLLETLEWLLQKNPQLGH

SEQ ID NO: 1029122 - protein, 1818 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRCHPLWEGVLLIEGSYPWPLIWKAKV

SEQ ID NO: 1029123 - protein, 578 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMVCFFPGIQILPTLVLW

SEQ ID NO: 1029124 - protein, 2310 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQVRLYFPCQSRSSLCPALVLSHPSQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 1029125 - protein, 2495 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRCHPLWEGVLLIEGSYPWPLIWKAKSKTGSIGLPLVLMAEPETLCGEFSIVYCLYHCGGPAWSLATVQCTASDLPVARGTSHRVFLTRATFRCDQRYITGISSQLYLSMMCEASALRCQELSVCCRGRGWGSGAISLRRAWLRAATRITHQRWFMLGNACCVPGGGPSTSHSASVPTSAQGRGAVIVCFSDKETEVRGAAFVVIPQMKEGILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 1029126 - protein, 295 aa, Homo sapiens
MITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLKEADTPKCEEKERRKRELRSSATGRSCRGASEQRLGDAPSCRVVVHGVQACRMEGVCLKCRGVKETSMPVYCSCAGDFALTIHTQVFMEQIGIFRNIAQHYGMSYLLETLEWLLQKNPQLGH

SEQ ID NO: 1029127 - protein, 636 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPIPLGGPFLYLGDGGHLAPQLPC

SEQ ID NO: 1029128 - protein, 360 aa, Homo sapiens
PRRAPAPIGAPRGAGEGRSAPLDGRRHFRLSLSLGGSAPNFSPEAEVVANGSMSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPVSFACVTFILKFPVFWREYSSVLESESDSKICLLLFPQILY

SEQ ID NO: 1029129 - protein, 2286 aa, Homo sapiens; identical to SEQ ID NO: 1029116

SEQ ID NO: 1029130 - protein, 89 aa, Homo sapiens
CLKKSTKEVFDELVALLQPLPCPCFAPVLSSEVCLMELPFGSNTSDQDLHGSGCGEWPEDTSLYLYFLQELHEQLGGVQASSSCQTPGI

SEQ ID NO: 1029131 - protein, 451 aa, Homo sapiens
ADTPCVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 1029132 - protein, 434 aa, Homo sapiens
ADTPCVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 1029133 - protein, 272 aa, Homo sapiens [sequence omitted]

SEQ ID NO: 1029134 - protein, 396 aa, Homo sapiens
ADTPCVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 1029135 - protein, 173 aa, Homo sapiens
MLNRLKQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 1029136 - protein, 451 aa, Homo sapiens; identical to SEQ ID NO: 1029131

SEQ ID NO: 1029137 - protein, 71 aa, Homo sapiens
FGGIGYVGCENGLDLVTIPEMGRVRLWDGVPAVQNPDPGVETVAVLPPQTKDVTKAMDEKKFDEALKLRGR

SEQ ID NO: 1029138 - protein, 272 aa, Homo sapiens [sequence omitted]

SEQ ID NO: 1029139 - protein, 242 aa, Homo sapiens
MQFGDTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 1029140 - protein, 433 aa, Homo sapiens
ADTPCVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 1029141 - protein, 451 aa, Homo sapiens; identical to SEQ ID NO: 1029131

SEQ ID NO: 1029142 - protein, 75 aa, Homo sapiens
SRTCSCERRSQPDGSDLSMSVQGWRTSSQLGRYCCEASRAPQPLRDQASLFTPELLQEARAAVAGRCLLFLTFSN

SEQ ID NO: 1029143 - protein, 182 aa, Homo sapiens
MALRPRSAPSRAPAWYTARRFCRSSASRRSRLRSLRRWEARRTRSSSVLWPSMACTSPRYCTRRPAHVLHVRAQPGLRRLQLLGHRCPRLLRHRGQLFLQFRFVGLQLLHGLVHQRPQFLGDLGAEQLLLHVLTQCMHPAQVIPKATQCQFPALAALPLGLLAQLGLRLCLHRCSSSDYTPG

SEQ ID NO: 1029144 - protein, 176 aa, Homo sapiens
RTASGAPPGPFLGLSRPGQPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 1029145 - protein, 122 aa, Homo sapiens
FLSEDVTTIRTSVTFKLNEGKCSLKNAELFPEGLRPALLGMESDGWCRELACMWEGACSQPSWRSMGARGCPADPSTLQMELNHPQLTGTQSQEEEEHNLACCIVLGSHLRGLHMHGIVGEL

SEQ ID NO: 1029146 - protein, 216 aa, Homo sapiens
FLSEDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRMLRKAVHREQFHLQLSGMNLDVAKKPPRTSERQAESCGVGQGHAENQCVSCRAGTYYDGARERCILCPNGTFQNEEGQMTCEPCPRSFIRLLRSKVSRFLRPYK

SEQ ID NO: 1029147 - protein, 458 aa, Homo sapiens
FLSEDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRMLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDDKHSLQHMERASLL

SEQ ID NO: 1029148 - protein, 508 aa, Homo sapiens
FLSEDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRMLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDDQREEEKQRSLREVTGKVGGKPKSMVSWKLSEELDQGGGVTSQVKATDASRRMKTKNWPLGFNT

SEQ ID NO: 1029149 - protein, 101 aa, Homo sapiens
SKSERVSLEATEFIRMQNMFFIPTEDYQELIEDIVRDGRLYASENHQEILKDKKLIKALFDVLAHPQNYFKYTAQESREMFPRSFIRLLRSKVSRFLRPYK

SEQ ID NO: 1029150 - protein, 521 aa, Homo sapiens
FLSEDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRMLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 1029151 - protein, 446 aa, Homo sapiens
FLSEDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRMLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDDA

SEQ ID NO: 1029152 - protein, 109 aa, Homo sapiens
DSGETAAASIPEPGPSISLRSTSSSSHNAIIKIPDLGLSLKILGPAWPTWSNPVSTKNTKISRAMVVHPCNPSSFGRLRQESHLNPGGRGCSELRLCHCTPWVTERHCV

SEQ ID NO: 1029153 - protein, 43 aa, Homo sapiens
MKDNSYLLGCDTRRRTYLTPDYEFSSTFTVICDHYNAHATTQT

SEQ ID NO: 1029154 - protein, 437 aa, Homo sapiens
MLKLNMKILICVKQQHKNLLSEHEQLVVTLEDHKSALAAAQTQVAEYKQLKDTLNRIPSLRKPDPAEQQNVTQVAHSPQGYNTAREKPTREVQEVSRNNDVWQNHEAVPGRAEDTKLYAPTHKEAEFQAPPEPIQQEVERREPEEHQVEEEHRKALEEEEMEQVGQAEHLEEEHDPSPEEQDREWKEQHEQREAANLLEGHARAEVYPSAKPMIKFQSPYEEQLEQQRLAVQQVEEAQQLREHQEALHQQRLQGHLLRQQEQQQQQVAREMALQRQAELEEGRPQHQEQLRQQAHYDAMDNDIVQGAEDQGIQGEEGAYERDNQHQDEAEGDPGNRHEPREQGPREADPESEADRAAVEDINPADDPNNQGEDEFEEAEQVREENLPDENEEQKQSNQKQENTEVEEHLVMAGNPDQQEDNVDEQYQEEAEEELQEL

SEQ ID NO: 1029155 - protein, 334 aa, Homo sapiens
MLKLNMKILICVKQQHKNLLSEHEQLVVTLEDHKSALAAAQTQVAEYKQLKDTLNRIPSLRKPDPAEQQNVTQVAHSPQGYNTAREKPTREVQEVSRNNDVWQNHEAVPGRAEDTKLYAPTHKEAEFQAPPEPIQQEVERREPEEHQVEEEHRKALEEEEMEQVGQAEHLEEEHDPSPEEQDREWKEQHEQREAANLLEGHARAEVYPSAKPMIKFQSPYEEQLEQQRLAVQQVEEAQQLREHQEALHQQRLQGHLLRQQEQQQQQVAREMALQRQAELEEGRPQHQEQLRQQAHYDAMDNDIVQGAEDQGIQGEEGAYERDNQQPRRSTRPRI

SEQ ID NO: 1029156 - protein, 201 aa, Homo sapiens
MNRYSVRLATCIPRERVIPRERVIPRERVISRERVIPRERVIPRERVIQHQEQLRQQAHYDAMDNDIVQGAEDQGIQGEEGAYERDNQHQDEAEGDPGNRHEPREQGPREADPESEADRAAVEDINPADDPNNQGEDEFEEAEQVREENLPDENEEQKQSNQKQENTEVEEHLVMAGNPDQQEDNVDEQYQEEAEEELQEL

SEQ ID NO: 1029157 - protein, 75 aa, Homo sapiens
GSYPYHSCVVVAFCQCEQVREENLPDENEEQKQSNQKQENTEVEEHLVMAGNPDQQEDNVDEQYQEEAEEELQEL

SEQ ID NO: 1029158 - protein, 493 aa, Homo sapiens
RQDFNSRYSALNVQHQMLKSQHEELKKQHSDLEEEHRKQGEDFSRTFNDHKQKYLQLQQEKEQELSKLKETVYNLREENRQLRKAPQDIHTQLQDVKTQVAEYKQLKDTLNRIPSLRKPDPAEQQNVTQVAHSPQGYNTAREKPTREVQEVSRNNDVWQNHEAVPGRAEDTKLYAPTHKEAEFQAPPEPIQQEVERREPEEHQVEEEHRKALEEEEMEQVGQAEHLEEEHDPSPEEQDREWKEQHEQREAANLLEGHARAEVYPSAKPMIKFQSPYEEQLEQQRLAVQQVEEAQQLREHQEALHQQRLQGHLLRQQEQQQQQVAREMALQRQAELEEGRPQHQEQLRQQAHYDAMDNDIVQGAEDQGIQGEEGAYERDNQHQDEAEGDPGNRHEPREQGPREADPESEADRAAVEDINPADDPNNQGEDEFEEAEQVREENLPDENEEQKQSNQKQENTEVEEHLVMAGNPDQQEDNVDEQYQEEAEEEVQEL

SEQ ID NO: 1029159 - protein, 114 aa, Homo sapiens
RQDFNSRYSALNVQHQMLKSQHEELKKQHSDLEEEHRKQGEDFSRTFNDHKQKYLQLQQEKEQELSKLKETVYNLREENRQLRKAPQDIHTQLQDVKVKENQTFHYLVFACFIW

SEQ ID NO: 1029160 - protein, 134 aa, Homo sapiens
MNRVNDPLIFIRDIKPGLKNLNVVFIVLEIGRVTKTKDGHEVRSCKVADKTGSITISVWDEIGGLIQPGDIIRLTRGYASMWKGCLTLYTGRGGELQKIGDLGAVQAAAMRDSIHYYPGNDLHPDLEEPSSLGV

SEQ ID NO: 1029161 - protein, 134 aa, Homo sapiens; identical to SEQ ID NO: 1029160

SEQ ID NO: 1029162 - protein, 70 aa, Homo sapiens
RRRSVTSAEGEGRAEGPAGARACSSESLFGTLGVRCSVSAPVSLSQPVPSRSPGQAGRAPVTRDQNQRRP

SEQ ID NO: 1029163 - protein, 110 aa, Homo sapiens
AATQRDFSGGGGAGRGSCRRAGVFIGVAVWDAGCAVFCLRSRFAVTARSFPEPGTGWARARVSERDSGQKCPLTAFFFPFIQRTGQLVRLPSCRPVGSGVGVRSGSPFFL

SEQ ID NO: 1029164 - protein, 134 aa, Homo sapiens; identical to SEQ ID NO: 1029160

SEQ ID NO: 1029165 - protein, 70 aa, Homo sapiens; identical to SEQ ID NO: 1029162

SEQ ID NO: 1029166 - protein, 134 aa, Homo sapiens; identical to SEQ ID NO: 1029160

SEQ ID NO: 1029167 - protein, 134 aa, Homo sapiens; identical to SEQ ID NO: 1029160

SEQ ID NO: 1029168 - protein, 70 aa, Homo sapiens; identical to SEQ ID NO: 1029162

SEQ ID NO: 1029169 - protein, 103 aa, Homo sapiens
MNRVNDPLIFIRDIKPGLKNLNVVFIVLEIGRVTKTKDGHEVRSCKVADKTGSITISVWDEIGGLIQPGDIIRLTRGYASMWKGCLTLYTGRGGELQKIGEKY

SEQ ID NO: 1029170 - protein, 134 aa, Homo sapiens; identical to SEQ ID NO: 1029160

SEQ ID NO: 1029171 - protein, 136 aa, Homo sapiens
MNRVNDPLIFIRDIKPGLKNLNVVFIVLEIGRVTKTKDGHEVRSCKVADKTGSITISVWDEIGGLIQPGDIIRLTRGYASMWKGCLTLYTGRGGELQKIGEDFVWFIQKCQISVNPTQIIEDSRTKGHRVNRRIIP

SEQ ID NO: 1029172 - protein, 410 aa, Homo sapiens
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVRYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 1029173 - protein, 73 aa, Homo sapiens
FTWVHGHCCVAAAQSEEGAPGSLAGQVGAGSDYGFISPGHVFPEFKESDAMFAAERVSVGGRQGFWSRAAQEA

SEQ ID NO: 1029174 - protein, 410 aa, Homo sapiens; identical to SEQ ID NO: 1029172

SEQ ID NO: 1029175 - protein, 511 aa, Homo sapiens
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVVRSRRGRVRGSGGLEMGGARAPGWDPSVGSSAAPRFVNGPWGEVPLPGAPMRGAALEAPGATEELSQGVEPVGSRRCALGGQDARGFRGVHTCKPPRPGPQTPSSDFWKEVQLALPRKVRYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 1029176 - protein, 507 aa, Homo sapiens
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVRYRPVEGDPQTQLQDDKDPMLILRGRVPEGRALDSEVDPDPEGDLGMPAQPHSPTGEAQHSGGVGAGTGHMGLEGLQVLRTLPGTGSPCTASALEVLGPRSAWELPGPHRPSQQGVSRGSPWQWVWAKAVGGHLRRLGLPTPGVRGPVFGEPSAPPHTSGVSLGESRSSEVDVSDLGSRNYSARTDFYCLVSKDDM

SEQ ID NO: 1029177 - protein, 401 aa, Homo sapiens
KVLIKNTQRHKPGPHRAWRCIHSSLGAVDTPWGPAKGRVCSQRRTNDQHLPPGGEELEPWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVRYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 1029178 - protein, 398 aa, Homo sapiens
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVRYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 1029179 - protein, 410 aa, Homo sapiens; identical to SEQ ID NO: 1029172

SEQ ID NO: 1029180 - protein, 354 aa, Homo sapiens
MPGVCDRAPDFLSPSEDQVLRPALGSSVALNCTAWVVSGPHCSLPSVQWLKDGLPLGIGGHYSLHEYSWPYKPRGCGAGLPPGPAGPAAGRPALCQVPSQRAALVPGRVWGGGDKRDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVRYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 1029181 - protein, 479 aa, Homo sapiens [sequence omitted]

SEQ ID NO: 1029182 - protein, 167 aa, Homo sapiens
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLQGTSFQNSKRAMPCLLPRE

SEQ ID NO: 1029183 - protein, 106 aa, Homo sapiens
MGPSPAPSRTSASPPSLFRELALQATWLRCWPPSWSCWPCCWPPCSMSSAVSTCCSRARLSRIQRERCHVCCRESECGRPPGVLESGCSGSVKGSAGSPACLRVGG

SEQ ID NO: 1029184 - protein, 410 aa, Homo sapiens; identical to SEQ ID NO: 1029172

SEQ ID NO: 1029185 - protein, 281 aa, Homo sapiens [sequence omitted]

SEQ ID NO: 1029186 - protein, 467 aa, Homo sapiens
KVLIKNTQRHKPGPHRAWRCIHSSLGAVDTPWGPAKGRVCSQRRTNDQHLPPGGEELEPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVRYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 1029187 - protein, 410 aa, Homo sapiens; identical to SEQ ID NO: 1029172

SEQ ID NO: 1029188 - protein, 365 aa, Homo sapiens
MPGVCDRAPDFLSPSEDQVLRPALGSSVALNCTAWVVSGPHCSLPSVQWLKDGLPLGIGGHYSLHEYSWPYKPRGCGAGLPPGPAGPAAGRPALCQVPSQRAALVPGRVWGGGDKRREALRRLRLLQRLPRGPQVRELHPKAAAGAASGLQALPGRPDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVRYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 1029189 - protein, 169 aa, Homo sapiens
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINATAPRTASS

SEQ ID NO: 1029190 - protein, 410 aa, Homo sapiens; identical to SEQ ID NO: 1029172

SEQ ID NO: 1029191 - protein, 113 aa, Homo sapiens
MAALGSPSHTFRGLLRELRYLSAATGRPYRDTAAYRYLVKAFRAHRVTSEKLCRAQHELHFQAATYLCLLRSIRKHVALHQEFHGKGERSVEESAGLVGLKLPHQPGGKGWEP

SEQ ID NO: 1029192 - protein, 113 aa, Homo sapiens
MAALGSPAHTFRGLLRELRYLSAATGRPYRDTAAYRYLVKAFRAHRVTSEKLCRAQHELHFQAATYLCLLRSIRKHVALHQEFHGKGERSVEESAGLVGLKLPHQPGGKGWEP

SEQ ID NO: 1029193 - protein, 110 aa, Homo sapiens
MRLHAAACAAAMSLVIPEKFQHILRVLNTNIDGRRKIAFAITAIKGVGRRYAHVVLRKADIDLTKRAGELTEDEVERVITIMQNPRQYKIPDWFLNRPEGCKGWKIPARS

SEQ ID NO: 1029194 - protein, 110 aa, Homo sapiens; identical to SEQ ID NO: 1029193

SEQ ID NO: 1029195 - protein, 110 aa, Homo sapiens; identical to SEQ ID NO: 1029193

SEQ ID NO: 1029196 - protein, 110 aa, Homo sapiens; identical to SEQ ID NO: 1029193

SEQ ID NO: 1029197 - protein, 66 aa, Homo sapiens
EENPGGISGLCQGCNGYIRAAELRHVMATLGEKLPDGELDEMIREADMDGDGQVNYEEFVQMMTAK

SEQ ID NO: 1029198 - protein, 66 aa, Homo sapiens; identical to SEQ ID NO: 1029197

SEQ ID NO: 1029199 - protein, 124 aa, Homo sapiens
ARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 1029200 - protein, 214 aa, Homo sapiens
RHSPSPPHLTSPPPATDEGPAGGTLSGPAATAPPRLLDVGVQACPTHPPPPTAPRGHQSCRLGDSWSVKSRWCPCPQELGWASCARGVCAWSFCAWICIFIALLVETPRPVHPAKTPQAACGSRTLPPFPRCPLRARAATQACWLRPPLGQALAQPAEWGVVGQSPRSWAPAQAHRARPHPAAPRTATRGVLPLCPAPGTNSMFGVCLCLFFKK

SEQ ID NO: 1029201 - protein, 214 aa, Homo sapiens; identical to SEQ ID NO: 1029200

SEQ ID NO: 1029202 - protein, 292 aa, Homo sapiens
GFQPFIQTRTQKNTRHPLTLSGGGTLWRKDTAGLATALTSDHSGLPLPEMSVGWGLSATPRPSVCSGSAAVLAPGITVPESPAHPGTGRVIMGWTCLCWGLLIPKHLKSGSREQAMGTCTSNRGPPSTVRDGDEKQSSTKRPPQGQSVHDSRMVMSGLVFTSTGILVLSPMIFGRYRPAIPFHQRSSLAVLKIFSLVPWKINKFTRIMAFTKTRFSVPEGGLSRGSLLRRRFSSGPWGLTLGFPQPWMTLAVVSLLSWRALMSASHVCTLPMTLSTPDVPQNLSVMSMESRR

SEQ ID NO: 1029203 - protein, 118 aa, Homo sapiens
GFQPFIQTRTQKNTRHPLTLSGGGTLWRKDTAGLATALTSDHSGLPLPEMSVGWGLSATPRPSVCSGSAAVLAPGITVPESPAHPGTGRVIMGWTCLCWGLLIPKHLKSGSREQAMGT

SEQ ID NO: 1029204 - protein, 131 aa, Homo sapiens
IGPDIAHGGAVNKRLVLLVDEFKELVYHQITILMVKVTKRKHDNEGSGSKRPKVEYSEEELKTHISKGTLGKFTVAHAGKRPAGLTGLKSGLKKQELWEALHQALPGTDQRPRVQLPFRSVARLPGLVLSQ

SEQ ID NO: 1029205 - protein, 621 aa, Homo sapiens [sequence omitted]

SEQ ID NO: 1029206 - protein, 646 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELQVDRPVPKYHRTVT

SEQ ID NO: 1029207 - protein, 544 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVTEHAGAD

SEQ ID NO: 1029208 - protein, 398 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYRTQRVLL

SEQ ID NO: 1029209 - protein, 235 aa, Homo sapiens
CQICKNRNAEDLFMFERGFALSPRLEDPRLAGQDSSSLLSPLQARGRPAAGGDPPSRQTAAVTVPSTRQGLSPSPHSSLHLPIFCTISSVFPPWDAIAAAHPWMPTGYGVAVLWAASISPALVQRLSRAGPPQPLLRELKCVCKHPPPRAQAGQTHTHPVRPSWAHAHCGCRELSASTFPPCSAPSCCSRPVSRPSDLSSPSGAHTAPFPPWPLHQGMAGPTWGWAGVEPFNSQP

SEQ ID NO: 1029210 - protein, 110 aa, Homo sapiens
MEWQFSGRLPSLLPWCVCKHPPPRAQAGQTHTHPVRPSWAHAHCGCRELSASTFPPCSAPSCCSRPVSRPSDLSSPSGAHTAPFPPWPLHQGMAGPTWGWAGVEPFNSQP

SEQ ID NO: 1029211 - protein, 636 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESVLSSCCLLCPLCPAEGSPPGWPGLQLSAVSLASQGPACCWWRRSWMRRRGWRSAP

SEQ ID NO: 1029212 - protein, 630 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLLAGRRLL

SEQ ID NO: 1029213 - protein, 694 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESVLSSCCLLCPLCPAEGSPPGWPGLQLSAVSLRGRPAAGGDAPPSRQTAAVTVPSTRQGLSPSPHSSLHLPIFCTISSVFPPWDAIAAAHPWMPTGYGVAVLWAASISPALVRL

SEQ ID NO: 1029214 - protein, 206 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPM

SEQ ID NO: 1029215 - protein, 142 aa, Homo sapiens [sequence omitted]

SEQ ID NO: 1029216 - protein, 78 aa, Homo sapiens
ASRRRDSGRLFFLQPRCAHRGLRAQKCGRPAPGVDAMVLCPVIGKLLHKRVVLASASPRRQEILSNAGLRFEVVPSNV

SEQ ID NO: 1029217 - protein, 296 aa, Homo sapiens
MFLLKHLAPRMNRTGCSFLWKISRQAGIFCMSPSRADDAVHKACPSCAQSLPVAFRWLSCPQLLYTGSLGIADVHNVHLRLRPPMEGLPGSSVFALDLRCEISWMICSAIVFGEGLPMPRLLDHSTPVIPRPLKVIGNDGSLDSVHGLAKGLAQLLHAVSIHDDGMPTEGLAPLLVDVHLVLQWGLGFTFWLQADLTVLGTWANQMVLSQALIGSHLPNGTWGRPHYKSPLTAPRLPSKANRSQVAGHCQKYLARCRPIPQAGPEALAPGSHVATSVKALFRDRVPVQVGADLPQV

SEQ ID NO: 1029218 - protein, 704 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSDPAGFALRIFAGGSHSGKVTWSLGRARKEGHTFCPSALRNAAFPERVNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESCKPGAGLLLVETLLDEEKRVAQRALMQSLNMLVQTEGKERSLGEYQCLLELHGFHQVQVVHLGGVLDAILATKVAP

SEQ ID NO: 1029219 - protein, 804 aa, Homo sapiens
ASRRRDSGRLFFLQPRCAHRGLRAQKCGRPAPGVDAMVLCPVIGKLLHKRVVLASASPRRQEILSNAGLRFEVVPSKFKEKLDKASFATPYGYAMETAKQKALEVANRLYQKDLRAPDVVIGADTIVTVGGLILEKPVDKQDAYRMLSRLSGREHSVFTGVAIVHCSSKDHQLDTRVSEFYEETKVKFSELSEELLWEYVHSGEPMDKAGGYGIQALGGMLVESVHGDFLNVVGFPLNHFCKQLVKLYYPPRPEDLRRSVKHDSIPAADTFEDLSDVEGGGSEPTQRDAGSRDEKAEAGEAGQATAEAECHRTRETLPPFPTRLLELIEGFMLSKGLLTACKLKVFDLLKDEAPQKAADIASKVDASACGMERLLDICAAMGLLEKTEQGYSNTETANVYLASDGEYSLHGFIMHNNDLTWNLFTYLEFAIREGTNQHHRALGKKAEDLFQDAYYQSPETRLRFMRAMHGMTKLTACQVATAFNLSRFSSACDVGGCTGALARELAREYPRMQVTVFDLPDIIELAAHFQPPGPQAVQIHFAAGDFFRDPLPSAELYVLCRILHDWPDDKVHKLLSRVAESVLSSCCLLCPLCPAEGSPPGWPGLQLSAVSLRGRPAAGGDAPPSRQTAAVTVPSTRQGLSPSPHSSLHLPIFCTISSVFPPWDAIAAAHPWMPTGYGVAVLWAASISPALVQRLSRAGPPQPLLLGLKCVCKHPPPRAQAGQTHTHPVRPSWAHAHCGCRELSASTFPPCSAPSCCSRPVSRPSDLSSPSGAHTAPFPPWPLHQGMAGPTWGWAGVEPFNSQP

SEQ ID NO: 1029220 - protein, 126 aa, Homo sapiens
PRGGGTLAACFFCMPRCAHRGLRAQKCGRPAPGVDAMVLCPVIGKLLHKRVVLASASPRRQEILSNAGLRFEVVPSKFKEKLDKASFATPYGYAMETAKQKALEVANRLYQARGPCPSALMKIPLL

SEQ ID NO: 1029221 - protein, 146 aa, Homo sapiens
TSTCLSYSKTQPMTPNRGPLSPPNDLRPSHVISLPLHNAPHTRPTNQHTNHIPMMARCNTRKHIPRPPHTTCPKRPSIRDNPIYYLRSFFLRRIFLSLLPLQPSPYPPIRRALAPNRHHPAKSPRSPTPKHIRITRIRSINHLSSP

SEQ ID NO: 1029222 - protein, 51 aa, Homo sapiens
MQHNKTTLNIDTHPDPAPYVSCTDTTSRPSNHNTDTRSSPVQHHRYRATPP

SEQ ID NO: 1029223 - protein, 101 aa, Homo sapiens
SSSRPPPPPPPPAGASPAPAPPPAPPPPPPPKAPLRAPPFPPPFFPRRIPPSPFPPPPRPSPPIRRPPAPPRPPPAKSPRSPTPKHIRITRIRSINHLSSP

SEQ ID NO: 1029224 - protein, 146 aa, Homo sapiens; identical to SEQ ID NO: 1029221

SEQ ID NO: 1029225 - protein, 136 aa, Homo sapiens
GLIKTRPFPLKGAFNLLITPAKPMVFLPPQKALKLGFLPTPYPYPIWGVLPRKPFQGPPPPLSKKASPRDNPIYYLRSFFLRRIFLSLLPLQPSPYPPIRRALAPNRHHPAKSPRSPTPKHIRITRIRSINHLSSP

SEQ ID NO: 1029226 - protein, 146 aa, Homo sapiens; identical to SEQ ID NO: 1029221

SEQ ID NO: 1029227 - protein, 146 aa, Homo sapiens; identical to SEQ ID NO: 1029221

SEQ ID NO: 1029228 - protein, 275 aa, Homo sapiens
MGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 1029229 - protein, 291 aa, Homo sapiens
MTNDSEGKMGFKHPKIMGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 1029230 - protein, 216 aa, Homo sapiens [sequence omitted]

SEQ ID NO: 1029231 - protein, 291 aa, Homo sapiens; identical to SEQ ID NO: 1029229

SEQ ID NO: 1029232 - protein, 111 aa, Homo sapiens
MTQKGKWDLNTQKIGFVLYPPSGGPAWDLMDHENILFLTICFCWHYAVTIVIVGMNYAFITWLTSGPHLLRGWKAFKISASIQGNALPHVSSPPEPKEDYCLFLFQNASYP

SEQ ID NO: 1029233 - protein, 111 aa, Homo sapiens; identical to SEQ ID NO: 1029232

SEQ ID NO: 1029234 - protein, 291 aa, Homo sapiens; identical to SEQ ID NO: 1029229

SEQ ID NO: 1029235 - protein, 291 aa, Homo sapiens; identical to SEQ ID NO: 1029229

SEQ ID NO: 1029236 - protein, 273 aa, Homo sapiens
MTNDSEGKMGFKHPKIMGNFRGHALPGTFFFIIGLWWCTKSILKYICKKQKRTCYLGSALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 1029237 - protein, 291 aa, Homo sapiens; identical to SEQ ID NO: 1029229

SEQ ID NO: 1029238 - protein, 291 aa, Homo sapiens; identical to SEQ ID NO: 1029229

SEQ ID NO: 1029239 - protein, 310 aa, Homo sapiens
MTNDSEGKMGFKHPKIMGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLTSGPHLLRGWKAFKISASIQGNALPHVSSPPEPKEDYCLFLFQNASYP

SEQ ID NO: 1029240 - protein, 198 aa, Homo sapiens [sequence omitted]

SEQ ID NO: 1029241 - protein, 291 aa, Homo sapiens; identical to SEQ ID NO: 1029229

SEQ ID NO: 1029242 - protein, 310 aa, Homo sapiens; identical to SEQ ID NO: 1029239

SEQ ID NO: 1029243 - protein, 277 aa, Homo sapiens
SLARNMDRLSLDEEHYNRQEEWRRQLPESLGEGLRQGLSRLGISLLGAIAGIVDQPMQNFQKTSEAQASAGHKAKGVISGVGKGIMGVFTKPIGGAAELVSQTGYGILHGAGLSQLPKQRHQPSDLHADQAPNSHVKYVWKMLQSLGRPEVHMALDVVLVRGSGQEHEGCLLLTSEVLFVVSVSEDTQQQAFPVTEIDCAQDSKQNNLLTVQLKQPRVACDVEVRFRKQGNQDELAREVEEQAGHWYLGISELQPLDVAAGDHGDLLLRGGSVEAGC

SEQ ID NO: 1029244 - protein, 305 aa, Homo sapiens
SLARNMDRLSLDEEHYNRQEEWRRQLPESLGEGLRQGLSRLGISLLGAIAGIVDQPMQNFQKTSEAQASAGHKAKGVISGVGKGIMGVFTKPIGGAAELVSQTGYGILHGAGLSQLPKQRHQPSDLHADQAPNSHVKYVWKMLQSLGRPEVHMALDVVLVRGSGQEHEGCLLLTSEVLFVVSVSEDTQQQAFPVTEIDCAQDSKQNNLLTVQLKQPRVACDVEVDGVRERLSEQQYNRLVDYITKTSCHLAPSCSSMQIPCPVVAAEPPPSTVKTYHYLVDPHFAQVFLSKFTMVKNKALRKGFP

SEQ ID NO: 1029245 - protein, 305 aa, Homo sapiens; identical to SEQ ID NO: 1029244

SEQ ID NO: 1029246 - protein, 95 aa, Homo sapiens
DTQADGAPHSARSWAALPASEVVRGDTQHGDTQRLVTGGVDHVAQGLLGVLDAATLGVAVAQEHPATMTAAHRTRTHSRFTLMSTVTRFYNANFH

SEQ ID NO: 1029247 - protein, 178 aa, Homo sapiens
FFRKAFLKERKFPGPPEKSINKIGHALHAHDPFFKSITIPFKVQTLARSLGLQMPVVVQSMYIFKSPLIRTPPSCTRSPWAGCWACGSQWRMPRWRTAVSGSSLAPTPGPWSSSMEKWYTRASRTSLTARARPTLSTSWRPLAPPGARRTGSSQQLNCPFPNCTPKGSRRAGALAPPG

SEQ ID NO: 1029248 - protein, 159 aa, Homo sapiens
FFRKAFLIRKEISWSLRRNPSTKLATLCTPTTPFSRASHIPFKVQPLARSLGLQMPVVVQSMYIFKQPHFGGEVSPHQDASFLYTEPLGRVLGVWIAVEDATLENGCLWFIPGSHTRALVLIHGEVVHKSKQNLSDRSRQAYTFHLMEASGTTWSPENW

SEQ ID NO: 1029249 - protein, 113 aa, Homo sapiens
NDPLAGERLSLVIVLHTSGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 1029250 - protein, 212 aa, Homo sapiens
FFRKAFLIRKEISWSLRRNPSTKLATLCTPTTPFSRASHIPFKVQPLARSLGLQMPVVVQSMYIFKQPHFGGEVSPHQDASFLYTEPLGRVLGVWIAVEDATLENGCLWFIPGSHTSGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 1029251 - protein, 246 aa, Homo sapiens
FFRKAFLIRKEISWSLRRNPSTKLATLCTPTTPFSRASHIPFKVQPLARSLGLQMPVVVQSMYIFKQPHFGGEVSPHQDASFLYTEPLGRVLGVWIAVEDATLENGCLWFIPGSHTSEEPCLFCPLGTPHPLGRGTLRKEEFKALHLGLQGGVSRRMVRAPVGSAPGTSFLGSEPARDNSLFVPTPVQRGALVLIHGEVVHKSKQNLSDRSRQAYTFHLMEASGTTWSPENWLQPTAELPFPQLYT

SEQ ID NO: 1029252 - protein, 265 aa, Homo sapiens
QPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEMNIQQLTNYRKSVMSLAEAGKLYRKDLEIVLCSEPPM

SEQ ID NO: 1029253 - protein, 235 aa, Homo sapiens
QPPYLHLAELTASQFLEIWKHFDADGNGYIEGKELENFFQELEKARKGSGMLAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEMNIQQLTNYRKSVMSLAEAGKLYRKDLEIVLCSEPPM

SEQ ID NO: 1029254 - protein, 132 aa, Homo sapiens
PRVGTRGSTHASPRVATRRKKRRNNGRAKKGRGHVQPIRCTNCARCVPKDKAIKKFVIRNIVEAAAVRDISEASVFDAYVLPKLYVKLHYCVSCAIHSKVVRNRSREARKDRTPPPRFRPAGAAPRPPPKPM

SEQ ID NO: 1029255 - protein, 115 aa, Homo sapiens [sequence omitted]

SEQ ID NO: 1029256 - protein, 115 aa, Homo sapiens [sequence omitted]

SEQ ID NO: 1029257 - protein, 115 aa, Homo sapiens
MTKKRRNNGRAKKGRGHVQPIRCTNCARCVPKDKAIKKFVIRNIVEAAAVRDISEASVFDAYVLPKLYVKLHYCVSCVIHSKVVRNRSREARKDRTPPPRFRPAGAAPRPPPKPM

SEQ ID NO: 1029258 - protein, 115 aa, Homo sapiens; identical to SEQ ID NO: 1029257

SEQ ID NO: 1029259 - protein, 115 aa, Homo sapiens [sequence omitted]

SEQ ID NO: 1029260 - protein, 115 aa, Homo sapiens; identical to SEQ ID NO: 1029257

SEQ ID NO: 1029261 - protein, 115 aa, Homo sapiens; identical to SEQ ID NO: 1029257

SEQ ID NO: 1029262 - protein, 132 aa, Homo sapiens; identical to SEQ ID NO: 1029254

SEQ ID NO: 1029263 - protein, 107 aa, Homo sapiens
MTKKRRNNGRAKKGRGHVQPIRCTNCARCVPKDKAIKKFVIRNIVEAAAVRDISEASVFDAYVLPKLYVKLHYCVSCAIHSKVVRNRSREARKDRTPPPATTRLWQV

SEQ ID NO: 1029264 - protein, 115 aa, Homo sapiens [sequence omitted]

SEQ ID NO: 1029265 - protein, 123 aa, Homo sapiens
ERTRVPPKMTKKRRNNGRAKKGRGHVQPIRCTNCARCVPKDKAIKKFVIRNIVEAAAVRDISEASVFDAYVLPKLYVKLHYCVSCAIHSKVVRNRSREARKDRTPPPRFRPAGAAPRPPPKPM

SEQ ID NO: 1029266 - protein, 115 aa, Homo sapiens
MPKKRRNNGRAKKGRGHVQPIRCTNCARCVPKDKAIKKFVIRNIVEAAAVRDISEASVFDAYVLPKLYVKLHYCVSCAIHSKVVRNRSREARKDRTPPPRFRPAGAAPRPPPKPM

SEQ ID NO: 1029267 - protein, 115 aa, Homo sapiens [sequence omitted]

SEQ ID NO: 1029268 - protein, 132 aa, Homo sapiens
MTKKRRNNGRAKKGRGHVRDHVHDMCWNNCDLNGVPGDKAQWIQDTVLLPIEQVSGGQYLSGNIRDRRDISEASVFDAYVLPKLYVKLHYCVSCAIHSKVVRNRSREARKDRTPPPRFRPAGAAPRPPPKPM

SEQ ID NO: 1029269 - protein, 115 aa, Homo sapiens; identical to SEQ ID NO: 1029257

SEQ ID NO: 1029270 - protein, 115 aa, Homo sapiens; identical to SEQ ID NO: 1029257

SEQ ID NO: 1029271 - protein, 115 aa, Homo sapiens [sequence omitted]

SEQ ID NO: 1029272 - protein, 569 aa, Homo sapiens
MAAAAPVAADDDERRRRPGAALEDSRSQEGANGEAESGELSRLRAELAGALAEMETMKAVAEVSESTKAEAVAAVQRQCQEEVASLQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 1029273 - protein, 149 aa, Homo sapiens
TPRSPDSRANVCIEENMSLEELSEEDLKNKGEGEERGGRESHPLLRASPPRLYNGMLGTRTGGSSDCEPRIRPIPASHPQPAPRDPPTLTKEMHAARRRIRTRRSSNCSITSSHRVFPSSAGSSTQEKEEKDRFIWGSASCPPHPRLCG

SEQ ID NO: 1029274 - protein, 570 aa, Homo sapiens
MSSMSRVRVVCRVVVCARVVLVCHVYTCVISHYSVVCVSMYVVYVRMYVIRIVSPYVSVCVSVSCVSRRVCVSHMYVYVLCVSSVRVQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 1029275 - protein, 505 aa, Homo sapiens
MPIRRQMAMAVPLLSPVIMITRIPASRHSWMEPVTSLRGGSSMPTTPTNVRSVSYSRNLAESSRTISSRFGGVSRVARAKQRRVSRPVPHSLITAMIFSFTGPVSGTLGGANSHIVTAVDDALRGTLDKHLVAHSSPGRFGWGAKTDMDFLSRENSRVNSFFISWRITELQALALSTFERLLTSVLNTFIFSTRVVKCCLGGLADLLIDTFGLVEVQGGVIAEGTDGGQLHQPVILPWPDWLIILQDLSLWSVSGAGDGELIQEADVPIHLVNDKHLADRHLVGGEGACLVGTDDRGAAQGLYGGQASYNGILLCHPTGTQGQAGGDDCRKTFGDGSHSQGHGNLKVVDGPAEPGAPMDGVVEVANVDKPDSHTDEGDDLGELLPKLIQLLLQGGLVLFCGSHLVSDLPNLGAHTSGGHDAQGLAGCNVGAREKHVLLVLVDSSGVRNGLRVFDDRYRLACQDGLVNPQRGGFDGEDSDVCRDFVPHSHLHDVPRDDVPSLDPLH

SEQ ID NO: 1029276 - protein, 505 aa, Homo sapiens; identical to SEQ ID NO: 1029275

SEQ ID NO: 1029277 - protein, 160 aa, Homo sapiens [sequence omitted]

SEQ ID NO: 1029278 - protein, 105 aa, Homo sapiens
SAEETEVLEGECVLEVSWGSPTLAGQVGKGRGHGPDVSPCPDFPASLCSLRTEMERVQQEQSKAQLPDLLSEQRAKVLRLQAELETSEQVQRDFVRRQAAAFWSA

SEQ ID NO: 1029279 - protein, 503 aa, Homo sapiens
MAAAAPVAADDDERRRRPGAQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 1029280 - protein, 504 aa, Homo sapiens
LESSEQKRAVLRARSAREVLAQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 1029281 - protein, 569 aa, Homo sapiens; identical to SEQ ID NO: 1029272

SEQ ID NO: 1029282 - protein, 569 aa, Homo sapiens; identical to SEQ ID NO: 1029272

SEQ ID NO: 1029283 - protein, 342 aa, Homo sapiens
MAAAAPVAADDDERRRRPGAALEDSRSQEGANGEAESGELSRLRAELAGALAEMETMKAVAEVSESTKAEAVAAVQRQCQEEVASLQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNIR

SEQ ID NO: 1029284 - protein, 569 aa, Homo sapiens; identical to SEQ ID NO: 1029272

SEQ ID NO: 1029285 - protein, 379 aa, Homo sapiens
GRSVSAGDGEKGAHSGIVSTLEVEFTGLAGGHVESRTSRFLACPLQRDLRALGGGKGGQQEAVTGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 1029286 - protein, 569 aa, Homo sapiens; identical to SEQ ID NO: 1029272

SEQ ID NO: 1029287 - protein, 505 aa, Homo sapiens
MPIRRQMAMAVPLLSPVIMITRIPASRHSWMEPVTSLRGGSSMPTTPTNVRSVSYSRNLAESSRTISSRFGGVSRVARAKQRRVSRPVPHSLITAMIFSFTGPVSGTLGGANSHIVTAVDDALRGTLDKHLVAHSSPGRFGWGAIDNMDFLSRENSRVNSFFISWRITELQALALSTFERLLTSVLNTFIFSTRVVKCCLGGLADLLIDTFGLVEVQGGVIAEGTDGGQLHQPVILPWPDWLIILQDLSLWSVSGAGDGELIQEADVPIHLVNDKHLADRHLVGGEGACLVGTDDRGAAQGLYGGQASYNGILLCHPTGTQGQAGGDDCRKTFGDGSHSQGHGNLKVVDGPAEPGAPMDGVVEVANVDKPDSHTDEGDDLGELLPKLIQLLLQGGLVLFCGSHLVSDLPNLGAHTSGGHDAQGLAGCNVGAREKHVLLVLVDSSGVRNGLRVFDDRYRLACQDGLVNPQRGGFDGEDSDVCRDFVPHSHLHDVPRDDVPSLDPLH

SEQ ID NO: 1029288 - protein, 159 aa, Homo sapiens
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGELLVHTGFLGSSQDRSAYQTIDSAEAPADPFAVPEGRSQDARGY

SEQ ID NO: 1029289 - protein, 104 aa, Homo sapiens [sequence omitted]

SEQ ID NO: 1029290 - protein, 184 aa, Homo sapiens
MELPAVNLKVILLGHWLLTTCFWRHFSAKPRLETIELTCALCKLRSAAHRAQLGCIVFSGSYAWANFTILALGVWAVAQRDSIDAISMFLGGLLATIFLDIVHISIFYPRVSLTDTGRFGVGMAILSLLLKPLSCCFVYHMYRERGGFLGSSQDRSAYQTIDSAEAPADPFAVPEGRSQDARGY

SEQ ID NO: 1029291 - protein, 134 aa, Homo sapiens
MELGCIVFSGSYAWANFTILALGVWAVAQRDSIDAISMFLGGLLATIFLDIVHISIFYPRVSLTDTGRFGVGMAILSLLLKPLSCCFVYHMYRERGGFLGSSQDRSAYQTIDSAEAPADPFAVPEGRSQDARGY

SEQ ID NO: 1029292 - protein, 149 aa, Homo sapiens
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGVLRSLSRSATDDDSQSAQILAVQRQINHEVLTTAE

SEQ ID NO: 1029293 - protein, 152 aa, Homo sapiens
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGFLGSSQDRSAYQTIDSAEAPADPFAVPEGRSQDARGY

SEQ ID NO: 1029294 - protein, 159 aa, Homo sapiens; identical to SEQ ID NO: 1029288

SEQ ID NO: 1029295 - protein, 104 aa, Homo sapiens [sequence omitted]

SEQ ID NO: 1029296 - protein, 152 aa, Homo sapiens; identical to SEQ ID NO: 1029293

SEQ ID NO: 1029297 - protein, 82 aa, Homo sapiens
VAATGGAGPGKFVPRVRSLGAPRGCGAGALGLSRDGAACCEPEGDSPRSLAADNLAEGLHTLQELGGRRGSAHQSSPGPSPQ

SEQ ID NO: 1029298 - protein, 169 aa, Homo sapiens
HSWEGGNTVIYLGCGKSLWGRTSHLRAYLRWPFLENRPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 1029299 - protein, 169 aa, Homo sapiens; identical to SEQ ID NO: 1029298

SEQ ID NO: 1029300 - protein, 181 aa, Homo sapiens
MRQFINPAWFVLMLLVGSCHLSGDSVQISLSLMRGQYRRPHICVSCDATISLQHAFQESLERSRDVGHTLVELSAEVRLGTMTAVSTDVPHRSGYMEPTPAPPTGGYTGAAHVERSSLMYETSLYIVEEASSLRCCGQLDGYPPIRRTFSFPDYFEEGCQSSDELLLVQVFTVTPGIVRLD

SEQ ID NO: 1029301 - protein, 37 aa, Homo sapiens
MVCSNASCWQLPPVRRFCPDLFVPSVVFSQPYSSSSA

SEQ ID NO: 1029302 - protein, 89 aa, Homo sapiens
VKYRLEASLVGFVLFRTFHGNSSETFGPSWRLHCQREGHSAAAQVTQPELTAHSHPFRFLTFLKIANDRMCGRVSHKGPLGPCLADPDG

SEQ ID NO: 1029303 - protein, 398 aa, Homo sapiens
MSEGNAAGEPSTPGGPRPLLTGARGLIGRRPAPPLTPGRLPSIRSRDLTLGGVKKKTFTPNIISRKIKEEPKEEVTVKKEKRERDRDRQREGHGRGRGRPEVIQSHSIFEQGPAEMMKKKGNWDKTVDVSDMGPSHIINIKKEKRETDEETKQILRMLEKDDFLDDPGLRNDTRNMPVQLPLAHSGWLFKEENDEPDVKPWLAGPKEEDMEVDIPAVKVKEEPRDEEEEAKMKAPPKAARKTPGLPKDVSVAELLRELSLTKEEELLFLQLPDTLPGQPPTQDIKPIKTEVQGEDGQVVLIKQEKDREAKLAENACTLADLTEGQVGKLLIRKSGRVQLLLGKVTLDVTMGTACSFLQELVSVGLGDSRTGEMTVLGHVKHKLVCSPDFESLLDHKHR

SEQ ID NO: 1029304 - protein, 398 aa, Homo sapiens; identical to SEQ ID NO: 1029303

SEQ ID NO: 1029305 - protein, 398 aa, Homo sapiens; identical to SEQ ID NO: 1029303

SEQ ID NO: 1029306 - protein, 167 aa, Homo sapiens
GSPFNPTITKTPGLPKDVSVAELLRELSLTKEEELLFLQLPDTLPGQPPTQDIKPIKTEVQGEDGQVVLIKQEKDREAKLAENACTLADLTEGQVGKLLIRKSGRVQLLLGKVTLDVTMGTACSFLQELVSVGLGDSRTGEMTVLGHVKHKLVCSPDFESLLDHKHR

SEQ ID NO: 1029307 - protein, 127 aa, Homo sapiens
RLVALQVRLRLAVLSRGPGNMSEGNAAGEPSTPGGPRPLLTGARGLIGRRPAPPLTPGRLPSIRSRDLTLGGVKKKTFTPNIISRKIKEEPKEEVTVKKEKRGDGTSLLLGTWPCYLFLYLCLNLFH

SEQ ID NO: 1029308 - protein, 127 aa, Homo sapiens; identical to SEQ ID NO: 1029307

SEQ ID NO: 1029309 - protein, 398 aa, Homo sapiens; identical to SEQ ID NO: 1029303

SEQ ID NO: 1029310 - protein, 399 aa, Homo sapiens
MSEGNAAGEPSTPGGPRPLLTGARGLIGRRPAPPLTPGRLPSIRSRDLTLGGVKKKTFTPNIISRKIKEEPKEEVTVKKEKRERDRDRQREGHGRGRGRPEVIQSHSIFEQGPAEMMKKKGNWDKTVDVSDMGPSHIINIKKEKRETDEETKQILRMLEKDDFLDDPGLRNDTRNMPVQLPLAHSGWLFKEENDEPDVKPWLAGPKEEDMEVDIPAVKVKEEPRDEEEEAKMKAPPKAARKTPGLPKDVSVAELLRELSLTKEEELLFLQLPDTLPGQPPTQDIKPIKTEVQGEDGQVVLIKQEKDREAKLAENACTLADLTEGQVGKLLIRKSGRVQLLLGKVTLDVTMGTACSFLQELVSVGLGDSRTGEMTVLGHVKHKLVCSPDFESLLDHKHRC

SEQ ID NO: 1029311 - protein, 398 aa, Homo sapiens; identical to SEQ ID NO: 1029303

SEQ ID NO: 1029312 - protein, 398 aa, Homo sapiens; identical to SEQ ID NO: 1029303

SEQ ID NO: 1029313 - protein, 398 aa, Homo sapiens; identical to SEQ ID NO: 1029303

SEQ ID NO: 1029314 - protein, 399 aa, Homo sapiens; identical to SEQ ID NO: 1029310

SEQ ID NO: 1029315 - protein, 477 aa, Homo sapiens [sequence omitted]

SEQ ID NO: 1029316 - protein, 252 aa, Homo sapiens
MLMAWCRGPVLLCLRQGLGTNSFLHGLGQEPFEGARSLCCRSSPRDLRDGEREHEAAQRKAPGAESCPSLPLSISDIGTGCLSSLENLRLPTLREESSPRELEDSSGDQGRCGPTHQGSEDPSMLSQAQSATEVEERHVSPSCSTSRERPFQAGELILAETGEGETKFKKLFRLNNFGLLNSNWGAVPFGKIVGKFPGQILRSSFGKQYMLRRPALEDYVVLMKRGTAITFPKGSFGYVKSSCYFACFLPTS

SEQ ID NO: 1029317 - protein, 367 aa, Homo sapiens
MLMAWCRGPVLLCLRQGLGTNSFLHGLGQEPFEGARSLCCRSSPRDLRDGEREHEAAQRKAPGAESCPSLPLSISDIGTGCLSSLENLRLPTLREESSPRELEDSSGDQGRCGPTHQGSEDPSMLSQAQSATEVEERHVSPSCSTSRERPFQAGELILAETGEGETKFKKLFRLNNFGLLNSNWGAVPFGKIVGKFPGQILRSSFGKQYMLRRPALEDYVVLMKRGTAITFPKDINMILSMMDINPGDTVLEAGSGSGGMSLFLSKAVGSQGRVISFEVRKDHHDLAKKNYKHWRDSWKLSHVEEWPDNVDFIHKDISGATEDIKSLTFDAVALDMLNPHVTLPVFYPHLKHGGVCAVYVVKWNSHL

SEQ ID NO: 1029318 - protein, 252 aa, Homo sapiens; identical to SEQ ID NO: 1029316

SEQ ID NO: 1029319 - protein, 393 aa, Homo sapiens
MLMAWCRGPVLLCLRQGLGTNSFLHGLGQEPFEGARSLCCRSSPRDLRDGEREHEAAQRKAPGAESCPSLPLSISDIGTGCLSSLENLRLPTLREESSPRELEDSSGDQGRCGPTHQGSEDPSMLSQAQSATEVEERHVSPSCSTSRERPFQAGELILAETGEGETKFKKLFRLNNFGLLNSNWGAVPFGKIVGKFPGQILRSSFGKQYMLRRPALEDYVVLMKRGTAITFPKDINMILSMMDINPGDTVLEAGSGSGGMSLFLSKAVGSQGRVISFEVRKDHHDLAKKNYKHWRDSWKLSHVEEWPDNVDFIHKDISGATEDIKSLTFDAVALDMLNPHVTLPVFYPHLKHGGVCAVYVVKKNRILIFHMDHFPMLLDQYTGNLVIQLFLSS

SEQ ID NO: 1029320 - protein, 477 aa, Homo sapiens [sequence omitted]

SEQ ID NO: 1029321 - protein, 477 aa, Homo sapiens [sequence omitted]

SEQ ID NO: 1029322 - protein, 477 aa, Homo sapiens [sequence omitted]

SEQ ID NO: 1029323 - protein, 255 aa, Homo sapiens
MLMAWCRGPVLLCLRQGLGTNSFLHGLGQEPFEGARSLCCRSSPRDLRDGEREHEAAQRKAPGAESCPSLPLSISDIGTGCLSSLENLRLPTLREESSPRELEDSSGDQGRCGPTHQGSEDPSMLSQAQSATEVEERHVSPSCSTSRERPFQAGELILAETGEGETKFKKLFRLNNFGLLNSNWGAVPFGKIVGKFPGQILRSSFGKQYMLRRPALEDYVVLMKRGTAITFPKVMDGDKVCIGFRRGKDRCSTQS

SEQ ID NO: 1029324 - protein, 433 aa, Homo sapiens
MLMAWCRGPVLLCLRQGLGTNSFLHGLGQEPFEGARSLCCRSSPRDLRDGEREHEAAQRKAPGAESCPSLPLSISDIGTGCLSSLENLRLPTLREESSPRELEDSSGDQGRCGPTHQGSEDPSMLSQAQSATEVEERHVSPSCSTSRERPFQAGELILAETGEGETKFKKLFRLNNFGLLNSNWGAVPFGKIVGKFPGQILRSSFGKQYMLRRPALEDYVVLMKRGTAITFPKDINMILSMMDINPGDTVLEAGSGSGGMSLFLSKAVGSQGRVISFEVRKDHHDLAKKNYKHWRDSWKLSHVEEWPDNVDFIHKDISGATEDIKSLTFDAVALDMLNPHVTLPVFYPHLKHGGVCAVYVVNITQVIELLDGIRTCELALSCEKISEVIVRDWLVCLAKQKNGILAQKVESKINTDVQLDSQEKIGVKGRIAF

SEQ ID NO: 1029325 - protein, 477 aa, Homo sapiens [sequence omitted]

SEQ ID NO: 1029326 - protein, 477 aa, Homo sapiens [sequence omitted]

SEQ ID NO: 1029327 - protein, 477 aa, Homo sapiens [sequence omitted]

SEQ ID NO: 1029328 - protein, 465 aa, Homo sapiens
MLMAWCRGPVLLCLRQGLGTNSFLHGLGQEPFEGARSLCCRSSPRDLRDGEREHEAAQRKAPGAESCPSLPLSISDIGTGCLSSLENLRLPTLREESSPRELEDSSGDQGRCGPTHQGSEDPSMLSQAQSATEVEERHVSPSCSTSRERPFQAGELILAETGEGETKFKKLFRLNNFGLLNSNWGAVPFGKIVGKFPGQILRSSFGKQYMLRRPALEDYVVLMKRGTAITFPKDINMILSMMDINPGDTVLEAGSGSGGMSLFLSKAVGSQGRVISFEVRKDHHDLAKKNYKHWRDSWKLSHVEEWPDNVDFIHKDISGATEDIKSLTFDAVALDMLNPHVTLPVFYPHLKHGGVCAVYVVNITQVIELLDGIRTCELALSCEKISEVIVRDWLVCLAKQKNGILAQKVESKINTDVQLDSQEKIGVKGELFQEDDHEESHSDFPYGSFPYVARPVHWQPGHTGE

SEQ ID NO: 1029329 - protein, 149 aa, Homo sapiens
MLSRLQELRKEEETLLRLKAALHDQLNRLKVTPRPSPAPPPFLPSDHFPPTWASVVTTCCGQLLRYSLAVVAPIYRFTNKQVEELALQSMISSRRGDEMLSSHTVPEQSHDMLVHVDNEASINQTTLELSTKSHVTEEEEEEEEEESDS

SEQ ID NO: 1029330 - protein, 68 aa, Homo sapiens
MLSRLQELRKEEETLLRLKAALHDQLNRLKMLVHVDNEASINQTTLELSTKSHVTEEEEEEEEEESDS

SEQ ID NO: 1029331 - protein, 107 aa, Homo sapiens
MLSRLQELRKEEETLLRLKAALHDQLNRLKVEELALQSMISSRRGDEMLSSHTVPEQSHDVSLIKCRPRRECKVCSAPMLLGWWKNCCKSHYLAQRALRSADNSFLV

SEQ ID NO: 1029332 - protein, 103 aa, Homo sapiens
MLSRLQELRKEEETLLRLKAALHDQLNRLKVEELALQSMISSRRGDEMLSSHTVPEQSHDMLVHVDNEASINQTTLELSTKSHVTEEEEGDWILKNVLKDSTS

SEQ ID NO: 1029333 - protein, 107 aa, Homo sapiens; identical to SEQ ID NO: 1029331

SEQ ID NO: 1029334 - protein, 137 aa, Homo sapiens
MLSRLQELRKEEETLLRLKAALHDQLNRLKVEELALQSMISSRRGDEMLSSHTVPEQSHDMLVHVDNEASINQTTLELSTKSHVTEEEEEAEKMNHIPKVGGIAGFSVIRIAFLSLTLLKPIILLCAPASLNVMHEL

SEQ ID NO: 1029335 - protein, 133 aa, Homo sapiens
EDPLFIVWTECRADSSPEVGYVTRQHAEPASGTAQGGGDAAAVEGSPARPAEPPQGDPAALSCPSSIPPERPFPPNLGLCGDHLLRPASPLLTSCGGANLEVYKQTGSESPGEFAVRFLGPIFQNRDLSKSRV

SEQ ID NO: 1029336 - protein, 68 aa, Homo sapiens; identical to SEQ ID NO: 1029330

SEQ ID NO: 1029337 - protein, 318 aa, Homo sapiens
PPTPRGKRHLANMMGEDSETFTQEDIDRATGYLFPSGLFEKRARPVMKHPEQIFPRQRAIQWGEDGRPFHYLFYTGKQSYYSLMHDVYGMLLNLEKHQSHLQAKSLLPEKTVTRDVIGSRWLIKEELEEMLVEKLSDLDYMQFIRLLEKLLTSQCGAAEEEFVQRFRRSVTLESKKQLIEPVQYDEQGMAFSKSEGKRKTAKAEAIVYKHGSGRIKVNGIDYQLYFPITQDREQLMFPFHFVDRLGKHDVTCTVSGGGRSAQAGAIRLAMAKALCSFVTEDEVEWMRQAGLLTTDPRVRERKKPGQEGARRKFTWKKR

SEQ ID NO: 1029338 - protein, 181 aa, Homo sapiens
PPTPRGKRHLANMMGEDSETFTQEDIDRATGYLFPSGLFEKRARPVMKHPEQIFPRQRAIQWGEDGRPFHYLFYTGKQSYYSFDYQLYFPITQDREQLMFPFHFVDRLGKHDVTCTVSGGGRSAQAGAIRLAMAKALCSFVTEDEVEWMRQAGLLTTDPRVRERKKPGQEGARRKFTWKKR

SEQ ID NO: 1029339 - protein, 235 aa, Homo sapiens [sequence omitted]

SEQ ID NO: 1029340 - protein, 235 aa, Homo sapiens
MHLHAGLKSSVKDAEVSSCQYSSGKATLERSSTQTIDKSQQMQVHLHLLMNFYCLQYMQFIRLLEKLLTSQCGAAEEEFVQRFRRSVTLESKKQLIEPVQYDEQGMAFSKSEGKRKTAKAEAIVYKHGSGRIKVNGIDYQLYFPITQDREQLMFPFHFVDRLGKHDVTCTVSGGGRSAQAGAIRLAMAKALCSFVTEDEVEWMRQAGLLTTDPRVRERKKPGQEGARRKFTWKKR

SEQ ID NO: 1029341 - protein, 299 aa, Homo sapiens
MMGEDSETFTQEDIDRATGYLFPSGLFEKRARPVMKHPEQIFPRQRAIQWGEDGRPFHYLFYTGKQSYYSLMHDVYGMLLNLEKHQSHLQAKSLLPEKTVTRDVIGSRWLIKEELEEMLVEKLSDLDYMQFIRLLEKLLTSQCGAAEEEFVQRFRRSVTLESKKQLIEPVQYDEQGMAFSKSEGKRKTAKAEAIVYKHGSGRIKVNGIDYQLYFPITQDREQLMFPFHFVDRLGKHDVTCTVSGGGRSAQAGAIRLAMAKALCSFVTEDEVEWMRQGMSLGGTGMVAQYWLYMFICFLS

SEQ ID NO: 1029342 - protein, 647 aa, Homo sapiens [sequence omitted]

SEQ ID NO: 1029343 - protein, 187 aa, Homo sapiens
AFEWPRPRVPTLKAHPQASAAGSSGPWKPHPSPALLAGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNRGLVLPYTYLDPPLIENSVSI

SEQ ID NO: 1029344 - protein, 571 aa, Homo sapiens
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASVLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKLLIPHTRYTLHINTLARELLIVPGQVVDRSTGIGIEGFSELIQRNMKQLNYSLLCLPEDIRTRGVEDIPGYYYRDDGMQIWGAVERFVSEIIGIYYDVILALWLLSKEPGDQRPLGTYPDEHFTEEAPRRSIATFQSRLAQISRGIQERNRGLVLPYTYLDPPLIENSVSI

SEQ ID NO: 1029345 - protein, 117 aa, Homo sapiens
MAEFRVRVSTGEAFGAGTWDKVSVSIVGTRGESPPLPLDNLGKEPAGLPDGGHIQDRAGGLIAPEALCAAAATAAPPKLLCCCGGPLPRGPMGYLALLCDFPSLDYSAQQGSRKHTP

SEQ ID NO: 1029346 - protein, 676 aa, Homo sapiens
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASLLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKLLIPHTRYTLHINTLARELLIVPGQVVDRSTGIGIEGFSELIQRNMKQLNYSLLCLPEDIRTRGVEDIPGYYYRDDGMQIWGAVERFVSEIIGIYYPSDESVQDDRELQAWVREIFSKGFLNQESSGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNRGLVLPYTYLDPPLIENSVSI

SEQ ID NO: 1029347 - protein, 320 aa, Homo sapiens
MDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEQVSDLASRGQEPSKTYKQQGNDSLIDDSKLTSADDIGTWICKEPEKPSHTGRQVNTIGPSIKSAYTFINA

SEQ ID NO: 1029348 - protein, 332 aa, Homo sapiens
EREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIEQ

SEQ ID NO: 1029349 - protein, 182 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQMEQVSDPPVTRVSMPVCSSELCTLLHESACSHRSS

SEQ ID NO: 1029350 - protein, 1497 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYSSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPVGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLQGPPGPPGPRGPPGPSIPGPPGPRGPPGEGLPGPPGPPGSFLSNSETFLFGPPGPPGPPGPKGDQGPPGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 1029351 - protein, 270 aa, Homo sapiens
GGLSLSLSLQGGGRRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNERQNTFTR

SEQ ID NO: 1029352 - protein, 220 aa, Homo sapiens
GGLSLSLSLQGGGRRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCEHFLPPGSTVYRIMWPGPGKRWALAYC

SEQ ID NO: 1029353 - protein, 229 aa, Homo sapiens
GGLSLSLSLQGGGRRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDNHSAMRSPVWLPHPFPHNWPPTSVAWSASPPPPTFLSPPTPRPTRARPRSPLTPPLTGLPSLP

SEQ ID NO: 1029354 - protein, 235 aa, Homo sapiens
HRNPHRNLSSKPYAPHVRVIETLTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNERQNTFTR

SEQ ID NO: 1029355 - protein, 135 aa, Homo sapiens
GGLSLSLSLQGGGRRGCGASFSKPSSAILVAAATHALAAAMTEQMTLRGTLKGHNGWVTQIATTPQFPDMILSASRDKTIIMWKLTRDETNYGIPQRALRGHSHFVSDEPIPSDGQFALSGYCDGTVRVCDLHAY

SEQ ID NO: 1029356 - protein, 240 aa, Homo sapiens
MTLRGTLKGHNGWVTQIATTPQFPDIDPSSRALLEIDTIYPLCGNTGHQRGLTDTQHGKFTMPWRPIAGSTSPHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNERQNTFTR

SEQ ID NO: 1029357 - protein, 270 aa, Homo sapiens; identical to SEQ ID NO: 1029351

SEQ ID NO: 1029358 - protein, 267 aa, Homo sapiens
AGTGRSLRIGRRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNERQNTFTR

SEQ ID NO: 1029359 - protein, 189 aa, Homo sapiens
GGLSLSLSLQGGGRRGCGASFSKPSSAILVAAATHALAAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDASGGKDGQAMLWDLNERQNTFTR

SEQ ID NO: 1029360 - protein, 204 aa, Homo sapiens
MTLLILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNERQNTFTR

SEQ ID NO: 1029361 - protein, 172 aa, Homo sapiens
MVEAKALPIPTSVLGRAFNLTQRHRDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNERQNTFTR

SEQ ID NO: 1029362 - protein, 117 aa, Homo sapiens
MTERNCRLRVSALISILNRAGDECVFLAILGWIESRVNANGNIPRVVGAKIIDSSKVVHETHLTKCGCSMLVASFIAANHAANALVIVLLVGLGTYRWLKALMERWAKTRKAGRPNA

SEQ ID NO: 1029363 - protein, 214 aa, Homo sapiens
MSGLSFSEMEGCRNLLGLLDNDEIMALCDTVTNRLVQPQDRQDAVHAILAYSQSAEELLRRRKVHREVIFKYLATQGIVIPPATEKHNLIQHAKDYWQKQPQLKLKETPEPVTKTEDIHLFQQQVKEDKKAEKVDFRRLGEEFCHWFFGLLNSQNPFLGPPQDEWGPQHFWHDVKLRFYYNTSEQNVMDYHGAEIVSLRLLSLVKEEFLFLSPN

SEQ ID NO: 1029364 - protein, 214 aa, Homo sapiens; identical to SEQ ID NO: 1029363

SEQ ID NO: 1029365 - protein, 233 aa, Homo sapiens
HTSQTTYHLDQPISRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAAA

SEQ ID NO: 1029366 - protein, 233 aa, Homo sapiens; identical to SEQ ID NO: 1029365

SEQ ID NO: 1029367 - protein, 150 aa, Homo sapiens
HVLLTHHHRQWVHVLQLQPAAATPAVRTDPQYKAAGVRNPQQLAQPQVTMQQPAHVQGQEPLTASMLASAPPQEQKQMLGERLFPLIQAMHPTLAGKRTGRLEDNDPLHMLESPESLRSKVDEAVAVLQAPPAKEAAQKAVNSATGVPTV

SEQ ID NO: 1029368 - protein, 105 aa, Homo sapiens
MGDVEKGKKIFVQKCAQCHTVEKGGKHKTGPNLHGLFGRKTGQAAGFSYTDANKNKGITWGEDTLMEYLENPKKYIPGTKMIFAGIKKKGERADLIAYLKKATNE

SEQ ID NO: 1029369 - protein, 105 aa, Homo sapiens
MGDVEKGKKIFIMKCSQYHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 1029370 - protein, 145 aa, Homo sapiens
VALYTGYLSADRVSLDMREWGRPASERECSLCQRLKRELNMGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 1029371 - protein, 327 aa, Homo sapiens
VALYTGYLSADRVSLDMREWGRPASERECSLCQRLKRELNMGDVEKGKEEIKKRDNWDDDDDEKKEEAEVKPEVKISEKKKNSREDKKKERHQKKRQEDITRRDTWDDDDDDQKRGADDKTQSLTISETTQIRSRRPTADPTGTTTHRPSKTLPTQRDSLDAMTDDPTPRPPEVTTPRYTFQNTTTHFAEKQHDDQTRNPQPTPPTHLQPHASLGTDERLPGPPTHATQAGKHPEVDTSLETKQQSAAADNRDTNRHTDRARGPNTAGITGSSRDQNEGYPSNQRHLQHPPSPYTTRHPQRPTPGHAAQTHDPDHGPTSGNTNAAHS

SEQ ID NO: 1029372 - protein, 105 aa, Homo sapiens
MGDVEKGKKIFVQKCAQCHTVEKGGKHKTGPNLHGLFGRKTGQAAGFSYTDANKNKGITWGEDTLMEYLENPKKYIPGTKMIFVGIKKKEERADLIAYLKKATNE

SEQ ID NO: 1029373 - protein, 105 aa, Homo sapiens; identical to SEQ ID NO: 1029369

SEQ ID NO: 1029374 - protein, 105 aa, Homo sapiens; identical to SEQ ID NO: 1029369

SEQ ID NO: 1029375 - protein, 105 aa, Homo sapiens; identical to SEQ ID NO: 1029369

SEQ ID NO: 1029376 - protein, 105 aa, Homo sapiens
MKDRLPGGTPMRYMETASQMNGREESFTGLYGEQEIQSQRPPGVTLIDRAGLNKNKGIIWGEDTLMEYLENPKKYIPGTKMIFVGIKKKEERADLIAYLKKATNE

SEQ ID NO: 1029377 - protein, 376 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029378 - protein, 376 aa, Homo sapiens; identical to SEQ ID NO: 1029377

SEQ ID NO: 1029379 - protein, 376 aa, Homo sapiens; identical to SEQ ID NO: 1029377

SEQ ID NO: 1029380 - protein, 376 aa, Homo sapiens; identical to SEQ ID NO: 1029377

SEQ ID NO: 1029381 - protein, 376 aa, Homo sapiens; identical to SEQ ID NO: 1029377

SEQ ID NO: 1029382 - protein, 376 aa, Homo sapiens; identical to SEQ ID NO: 1029377

SEQ ID NO: 1029383 - protein, 376 aa, Homo sapiens; identical to SEQ ID NO: 1029377

SEQ ID NO: 1029384 - protein, 383 aa, Homo sapiens
MCLNLLAQLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029385 - protein, 383 aa, Homo sapiens; identical to SEQ ID NO: 1029384

SEQ ID NO: 1029386 - protein, 386 aa, Homo sapiens
MEPQGATQQEVLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029387 - protein, 353 aa, Homo sapiens
MTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029388 - protein, 376 aa, Homo sapiens; identical to SEQ ID NO: 1029377

SEQ ID NO: 1029389 - protein, 376 aa, Homo sapiens; identical to SEQ ID NO: 1029377

SEQ ID NO: 1029390 - protein, 230 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASASQWTLQTQMVSHCGILRRSSCLSAASPGPAPPASQWPLSAQPSSWLSAAFPGPAFDFWQPLQAQNLISSRPLQARPPASRRPARARPRPRPHSGLSTPS

SEQ ID NO: 1029391 - protein, 416 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPASCLPKACTGPASASQRTLQAQLAVASLRPPESKAPASRPLRQAQLPPASGLFRPMGLIPDNGLSRPSFSLPAASPGPEPPQVGLSRPTCTLRASSPGPALLPGCVSRPDSCLSTTSLDSVPTHLLGGPGRPTTSLSQAPQAQLRPRGGLSRLSSWPSDDICRPQMASGRWAPLGPAWASRRPLQAQIVPKSVSPGLAPASRRPLQAQVVLKSAWKWAWKSSKSASPGPAPSSRRPLQVQNFLESASPGPAPPASQWPLSAQPSSWLSAAFPGPAFDFWQPLQAQNLISSRPLQARPPASRRPARARPRPRPHSGLSTPS

SEQ ID NO: 1029392 - protein, 339 aa, Homo sapiens
MAYLGPYPTSRQSPQMSLLPHNSLHRHSSIVTMASLDPAPASQPSLQALNFLKSTSPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029393 - protein, 290 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSGLSLYKLR

SEQ ID NO: 1029394 - protein, 242 aa, Homo sapiens
GKRPRYPLRIVSQRDSLRLGTHTTAREPLLPRTPGPNNVFGLSSCPAPSGPGRPTTSLSQAPQAQLRPRGGLSRLSSWPSDDICRPQMASGRWAPLGPAWASRRPLQAQIVPKSVSPGLAPASRRPLQAQVVLKSAWKWAWKSSKSASPGPAPSSRRPLQVQNFLESASPGPAPPASQWPLSAQPSSWLSAAFPGPAFDFWQPLQAQNLISSRPLQARPPASRRPARARPRPRPHSGLSTPS

SEQ ID NO: 1029395 - protein, 307 aa, Homo sapiens
MASLDPAPASQPSLQALNFLKSTSPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029396 - protein, 175 aa, Homo sapiens
MASLDPAPASQPSLQALNFLKSTSPGPAHASLQPLQAQLLHLGGPSRPSLCLPSASTVPTSASQQILHAQHLPHCGPPKPSSQPFSSFYTPSSCHPVASLGQAHASQGPFQAQLLSHGNLPWPDSCLSPSSLDRPRSCLTLASLHPAYASRWPLQAQLLSQDVISGPKTYSSQTL

SEQ ID NO: 1029397 - protein, 161 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASTSLWTPQRARLFPIQNRPSARAFTSGISYDM

SEQ ID NO: 1029398 - protein, 114 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVGL

SEQ ID NO: 1029399 - protein, 231 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPASCLPKACTGPASASQRTLQAQLAVASLRPPESKAPASRPLRQAQLPPASGLFRPMGLIPDNGLSRPSFSLPAASPGPEPPQVGLSRPTCTLRASSPGPALLPGCVSRPDSCLPTTSLDSAPAQLPAALVGPQLP

SEQ ID NO: 1029400 - protein, 231 aa, Homo sapiens; identical to SEQ ID NO: 1029399

SEQ ID NO: 1029401 - protein, 105 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTVSLCCPRLECSSAMLYAHLCGW

SEQ ID NO: 1029402 - protein, 34 aa, Homo sapiens
MAPTSRQPLQAQSFLQSASTDHAHEADMLIRDAY

SEQ ID NO: 1029403 - protein, 45 aa, Homo sapiens
MASLDPAPASQPSLQALNFQAQLLSCVGLYRPGIILSTASIGPAS

SEQ ID NO: 1029404 - protein, 376 aa, Homo sapiens; identical to SEQ ID NO: 1029377

SEQ ID NO: 1029405 - protein, 376 aa, Homo sapiens; identical to SEQ ID NO: 1029377

SEQ ID NO: 1029406 - protein, 376 aa, Homo sapiens; identical to SEQ ID NO: 1029377

SEQ ID NO: 1029407 - protein, 376 aa, Homo sapiens; identical to SEQ ID NO: 1029377

SEQ ID NO: 1029408 - protein, 376 aa, Homo sapiens; identical to SEQ ID NO: 1029377

SEQ ID NO: 1029409 - protein, 376 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASASLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029410 - protein, 393 aa, Homo sapiens
MEMKCLINVNVLKSFGPMLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029411 - protein, 339 aa, Homo sapiens
MAYLGPYPTSRQSPQMSLLPHNSLHRHSSIVTMASLDPAPASQPSLQALNFLKSTSPGPAHASLQPLQAQLLHLGGPSRPSLCLTADSSRPASTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029412 - protein, 353 aa, Homo sapiens; identical to SEQ ID NO: 1029387

SEQ ID NO: 1029413 - protein, 376 aa, Homo sapiens; identical to SEQ ID NO: 1029377

SEQ ID NO: 1029414 - protein, 416 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASLRPSLLPPEGLHRPSLCLTADSPSPASCCFTAASRVQSSCLSAASAGPAPACQWPLQAHGAHSSQRPFQAQFFPSGGLSGPRTSSSRPLQTHLHPPGVLSGPSSSSWLRLQARLLPPNNVFGLSSCPAPSGPGRPTTSLSQAPQAQLRPRGGLSRLSSWPSDDICRPQMASGRWAPLGPAWASRRPLQAQIVPKSVSPGLAPASRRPLQAQVVLKSAWKWAWKSSKSASPGPAPSSRRPLQVQNFLESASPGPAPPASQWPLSAQPSSWLSAAFPGPAFDFWQPLQAQNLISSRPLQARPPASRRPARARPRPRPHSGLSTPS

SEQ ID NO: 1029415 - protein, 175 aa, Homo sapiens; identical to SEQ ID NO: 1029396

SEQ ID NO: 1029416 - protein, 263 aa, Homo sapiens
MAYLGPYPTSRQSPQMSLLPHNSLHRHSSIVTMASLDPLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029417 - protein, 253 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASASQWTLQTQMVSHCGILRRSSCLSAASPGPAPPASQWPLSAQPSSCLPAAFPSPAFDFWWPLQASTRPSLLPLEGLHGPGLGLGLTADSPRPASSRLTAASPVQSSCLSATSAGPAPACQWPL

SEQ ID NO: 1029418 - protein, 345 aa, Homo sapiens
MAYLGPYPTSRQPPQMSLLPHNSLHRHSSIVTMASLDPAPASQPSLQALNFQAQLMLLCSLSRPSSCILVAPPGPASASRQPLQSQRLPHSRFFTPSISTSLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASWWPMKAQNLLKLTFPGPAPASCQRLQAQPLPHGGFSRPTSSSWLGLQAQLLPHNSLFWPSSCPAHGGQCRPKTSSSQTLQAHLLLPGGMNRPSFDLRTASAGPALASQGLFPGPALASWQLPQAKFLPACQQPQQA

SEQ ID NO: 1029419 - protein, 303 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASASLWTPQAKLPTFQQLLHTQLLPPSGLFRPSSCFTRAFPGPTFVSWQPSLARFLPVSQQPRQAQVLPHTGLSTSSLCLTVASPGPTPVPGRHLRAQNLLKSDSLVPTAASQQILHAQYLPHCGPPKPSSQPFSSFYTPSSCHPVASLGQAHASQGPFQAQLLSHGNLPGQIPA

SEQ ID NO: 1029420 - protein, 153 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPAPASWWPLQAQPLPPVSLYSPNVCLTADSSRPASASLWTPQAKLPTFSSFYTPSSKA

SEQ ID NO: 1029421 - protein, 231 aa, Homo sapiens
MLLPPGSLSRPRTFSSQPLQTKLMTHNGLFRPIPYVTAVSADEPTASQQPPQAQLHRYNGLFRPSSCLPAFSPGPELSQVDLTRPSSCFFAASPGPASCLPKACTGPASASQRTLQAQLAVASLRPPESKAPASRPLRQAQLPPASGLFRPMGLIPDNGLSRPSFSLPAASPGPEPPQVGLSRPTCTLRASSPGPALLPGCVSRPDSCLSTTSLDSVPTHLLAALVGPQLP

SEQ ID NO: 1029422 - protein, 100 aa, Homo sapiens
YPGAAPGLRTFSSQPLQTKLMTHNGLFRPIPYVTAASADEPTASQQPPQAQLHRYNGLFRPSSCLPAFSPGPELSQVSLCCPRLECSSAIAADCSLNLPG

SEQ ID NO: 1029423 - protein, 28 aa, Homo sapiens
MVSISDFLIRACEYPGACIFAKTVIKVA

SEQ ID NO: 1029424 - protein, 186 aa, Homo sapiens
VLVGHRAAVNVVDFDDKYMFLHLGIELVKVWNTSTCEFVRPLKGHKRGPACFPGQGQAGNEWAHLPPLSDLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 1029425 - protein, 186 aa, Homo sapiens; identical to SEQ ID NO: 1029424

SEQ ID NO: 1029426 - protein, 186 aa, Homo sapiens; identical to SEQ ID NO: 1029424

SEQ ID NO: 1029427 - protein, 28 aa, Homo sapiens
MVSISDFLIRACEYPGACIFAKTVIKVA

SEQ ID NO: 1029428 - protein, 28 aa, Homo sapiens
MVSISDFLIRACEYPGACIFAKTVIKVA

SEQ ID NO: 1029429 - protein, 127 aa, Homo sapiens
CDDETCEGSAKSNIAKYYELTMLSLLVSRTLGYTISRETQNLQVPYFVDKNFDKAYRGASLHDLEKTIEKDYIDYIQTSCWKEKQQKSELTNLAGLYRDERLKQKAESLKLENCEKLSKLIGLRRGG

SEQ ID NO: 1029430 - protein, 358 aa, Homo sapiens
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQKSELTNLAGLYRDERLKQKAESLKLENCEKLSKLIGLRRGG

SEQ ID NO: 1029431 - protein, 358 aa, Homo sapiens; identical to SEQ ID NO: 1029430

SEQ ID NO: 1029432 - protein, 358 aa, Homo sapiens; identical to SEQ ID NO: 1029430

SEQ ID NO: 1029433 - protein, 356 aa, Homo sapiens
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQKSELTNLAGLYRDERLKQKAESLKLENCEKLSKLPPPPP

SEQ ID NO: 1029434 - protein, 358 aa, Homo sapiens; identical to SEQ ID NO: 1029430

SEQ ID NO: 1029435 - protein, 344 aa, Homo sapiens
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQRFWHSPCFRTSAQQMSFEERILRSRKQ

SEQ ID NO: 1029436 - protein, 358 aa, Homo sapiens; identical to SEQ ID NO: 1029430

SEQ ID NO: 1029437 - protein, 258 aa, Homo sapiens
MSGLRPGRVRGTPRTVRNSCLGYKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQKSELTNLAGLYRDERLKQKAESLKLENCEKLSKLIGLRRGG

SEQ ID NO: 1029438 - protein, 645 aa, Homo sapiens
MSCQISCKSRGRGGGGGGFRGFSSGSAVVSGGSRRSTSSFSCLSRHGGGGGGFGGGGFGSRSLVGLGGTKSISISVAGGGGGFGAAGGFGGRGGGFGGGSGFGGGSGFGGGSGFSGGGFGGGGFGGGRFGGFGGPGGVGGLGGPGGFGPGGYPGGIHEVSVNQSLLQPLNVKVDPEIQNVKAQEREQIKTLNNKFASFIDKVRFLEQQNQVLQTKWELLQQMNVGTRPINLEPIFQGYIDSLKRYLDGLTAERTSQNSELNNMQDLVEDYKKKYEDEINKRTAAENDFVTLKKDVDNAYMIKVELQSKVDLLNQEIEFLKVLYDAEISQIHQSVTDTNVILSMDNSRNLDLDSIIAEVKAQYEEIAQRSKEEAEALYHSKYEELQVTVGRHGDSLKEIKIEISELNRVIQRLQGEIAHVKKQCKNVQDAIADAEQRGEHALKDARNKLNDLEEALQQAKEDLARLLRDYQELMNVKLALDVEIATYRKLLEGEECRMSGDLSSNVTVSVTSSTISSNVASKAAFGGSGGRGSSSGGGYSSGSSSYGSGGRQSGSRGGSGGGGSISGGGYGSGGGSGGRYGSGGGSKGGSISGGGYGSGGGKHSSGGGSRGGSSSGGGYGSGGGGSSSVKGSSGEAFGSSVTFSFR

SEQ ID NO: 1029439 - protein, 197 aa, Homo sapiens
MRAACSSLEEQLPSGTGQLCSESQTRRTDPYSSACTDRNRSIESQRRTTQPQHAPRPMITKRDQEVTPSDRKEQTNSTARTKRTTIHTENSTHHENNNRPRPHANTPMNKNPHSATITSSKQKRGRRGDEAQTPHNTTDREQPGERPETRATPAKPRAESTTHRAKQQHKQQPERHNSKQNEQHKKDHRTEATDTAK

SEQ ID NO: 1029440 - protein, 116 aa, Homo sapiens
MASVPSYPRPTYGIQDMPSWTRLTSHLAAPVHSAAVPTSLWVVGTIALLGFSVLGGAHLVLPLQLFPIVASHTWGHGRGYPWPLKGGPKPHLNPGNATNSNCPLDMADRLWSNWEE

SEQ ID NO: 1029441 - protein, 188 aa, Homo sapiens
MRAACSSLEEQLPSGTGQLCSAPSGPAPSPGPPSPPPLAANPHLPPVPSPPHYSSTPAAAGLPWAEWGAVLPLASVPSYPRPTYGIQDMPSWTRLTSHLAAPVHSAAVPTSLWVVGTIALLGFSVLGGAHLVLPLQLFPIVASHTWGHGRGYPWPLKGGPKPHLNPGNATNSNCPLDMADRLWSNWEE

SEQ ID NO: 1029442 - protein, 188 aa, Homo sapiens
MRAACSSLEEQLPSGTGQLCSAPSGPAPSPGPPSPPPLAANPHLPPVPSPPHYSSTPAAAGLPWAEWGAVLPLASVPSYPRHTYGIQDMPSWTRLTSHLAAPVHSAAVPTSLWVVGTIALLGFSVLGGAHLVLPLQLFPIVASHTWGHGRGYPWPLKGGPKPHLNPGNATNSNCPLDMADRLWSNWEE

SEQ ID NO: 1029443 - protein, 188 aa, Homo sapiens; identical to SEQ ID NO: 1029441

SEQ ID NO: 1029444 - protein, 170 aa, Homo sapiens
RGSRCLVWPYKGIVRGSGIKIWTYVLQWAIIQPITMGMIWKRKVTLMQKGEPKEGALGKAGGYNPEPEIFLPSFFIFYFFLRQSFALLPRLVSNSWAQAILLSQPPKVLGLQACPTMPRLIFTFNQTKIGLLLELLWLQLKESPCSHITRKHLLYAKNMVDLALQLLQIS

SEQ ID NO: 1029445 - protein, 559 aa, Homo sapiens
MRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 1029446 - protein, 86 aa, Homo sapiens
QGAQVWHSGAPSDPHTALLGWHVYRNPNGEGLPHWPLFDQEEQYLQLNLQPAVGRALKAHRLQFWKKALPQKIQELEEPEERHTEL

SEQ ID NO: 1029447 - protein, 543 aa, Homo sapiens
MRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHVKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 1029448 - protein, 3210 aa, Homo sapiens
MSWALEEWKEGLPTRTLQKIQELEGQLDKLKKEKQQRQFQLDSLEAAPQKQTQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGELEVTPSRSTLQIGKRDANSSFFGNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKINQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQTYVDSLKAENLVLSTNLRNFQGDLVKEMQLGLEEGLVPSLSSSCVPDSSSLSSLGDSSFYRALLEQTGDMSLLSNLEGVVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKEDLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKMDNLKYVNQLKKENERAQGKMKLLIKSCKQLEEEKEILQKELSQLQAAQEKQKTGTVMDTKVDELTTEIKELKETLEEKTKEADEYLDKYCSLLISHEKLEKAKEMLETQVAHLCSQQSKQDSRGSPLLGPVVPGPSPIPSVTEKRLSSGQNKASGKRQRSSGIWENGGGPTPATPESFSKKSKKAVMSGIHPAEDTEGTEFEPEGLPEVVKKGFADIPTGKTSPYILRRTTMATRTSPRLAAQKLALSPLSLGKENLAESSKPTAGGSRSQKVKVAQRSPVDSGTILREPTTKSVPVNNLPERSPTDSPREGLRVKRGRLVPSPKAGLESKGSENCKVQ

SEQ ID NO: 1029449 - protein, 126 aa, Homo sapiens
MCNNDQESEFPEGVLCSSSKKLIPVSIHCHHILSEKNSTGGAEQPSKNWNLKDGADVLCGLVEVGKYDEMEEKLDMPPGIFTYLLVPTMNNRFKRYALKICPFFSQVLKIQVPVSGSYVFWGENFI

SEQ ID NO: 1029450 - protein, 1320 aa, Homo sapiens
QNYSPQYDSYDVKSGGVAVGGLAGYPGPAGPPGPPGPPGTSGHPGSPGSPGYQGPPGEPGQAGPSGPPGPPGAIGPSGPAGKDGESGRPGRPGDRGLPGPPGIKGPAGIPGFPGMKGHRGFDGRNGEKGETGAPGLKGENGFQAKMELLDPWVQEGLLVSEDGQDFLGLQVLGVMTVLEAVMVNQALLVLLELPDSLDPLVLRVKLDLQGLLVQMVPLDKEENLDLRDTLVLKVLLALLGLMVVLVVKAKWVPLAFLELLDCWEPGVLQDQPVLMVLLDCEVVQVSLVRMVPKESPDHVVNAVRLVFQVFQELKAKMARMDHLETLVQMGFQELQEKGAPWVPEDLLDQMASQGRKALLESAVLQALQAPEELLENLAEMASLEVQEMRGMPGSPGGPGSDGKPGPPGSQGESGRPGPPGPSGPRGQPGVMGFPGPKGNDGAPGKNGERGGPGGPGPQGPPGKNGEYGPQGPPGPTGPGGDKGDTGPRGPQGLQGLPGTGGPPGENGKPGEPGPKGEAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGVPRAHQELQAHLGLLGSLEHGVLQDHQACQVLGEALALRVSRVKVGNQELTVSVENVVPLDPRVFLVWLVQLVNLEEMETLDQMVFQAEMDLLVARVIVVKMALLVPLALLVIQAHLVLSVQLERVVTEEKVALLALLVLPVLLVPEVLLVLKAHVVTKVKQVNVELLASKDIEDSLVIQVPQVLQALLVSRVQSAVQDLQAPEDLLDPVDLLAKMEPVDIQVPLDHQGLEVTEVKEDLRAPQATQGNQALLDLLVPLVLAVVVLEPLPLLGLEVKKLAVLPLIMEMNQWNFKINTDEIMTSLKSVNGQIESLISPDGSRKTPLETAEDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 1029451 - protein, 117 aa, Homo sapiens
LRSEKQIQNKQQHTWSLQTTYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 1029452 - protein, 1320 aa, Homo sapiens; identical to SEQ ID NO: 1029450

SEQ ID NO: 1029453 - protein, 941 aa, Homo sapiens
QNYSPQYDSYDVKSGGVAVGGLAGYPGPAGPPGPPGPPGTSGHPGSPGSPGYQGPPGEPGQAGPSGPPGPPGAIGPSGPAGKDGESGRPGRPGDRGLPGPPGIKGPAGIPGFPGMKGHRGFDGRNGEKGETGAPGLKGENGFQAKMELLDPWVQEGLLVSEDGQDFLGLQVLGVMTVLEAVMVNQALLVLLELPDSLDPLVLRVKLDLQGLLVQMVPLDKEENLDLRDTLVLKVLLALLGLMVVLVVKAKWVPLAFLELLDCWEPGVLQDQPVLMVLLDCEVVQVSLVRMVPKESPDHVVNAVRLVFQVFQELKAKMARMDHLETLVQMGFQELQEKGAPWVPEDLLDQMASQGRKALLESAVLQALQAPEELLENLAEMASLEVQEMRGMPGSPGGPGSDGKPGPPGSQGESGRPGPPGPSGPRGQPGVMGFPGPKGNDGAPGKNGERGGPGGPGPQGPPGKNGEYGPQGPPGPTGPGGDKGDTGPRGPQGLQGLPGTGGPPGENGKPGEPGPKGEAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGGWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 1029454 - protein, 1320 aa, Homo sapiens; identical to SEQ ID NO: 1029450

SEQ ID NO: 1029455 - protein, 589 aa, Homo sapiens
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTHPGVRREGGHGILWPKPAGRGESVTLLRTSYLLASLP

SEQ ID NO: 1029456 - protein, 583 aa, Homo sapiens
MAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 1029457 - protein, 593 aa, Homo sapiens
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 1029458 - protein, 593 aa, Homo sapiens; identical to SEQ ID NO: 1029457

SEQ ID NO: 1029459 - protein, 135 aa, Homo sapiens
MEPATAPRPDMAPELTPEEEQVSGPEAAALGVSGPPRPTPASASRVPALCSHGAAAPRSRARLAGLPHRRPRPRPPPPRRGTHGTLLPFPPLLSPRLTSLRRCPPHPTPYSRGKVPWIQGPSSRDLQNRCLPPAL

SEQ ID NO: 1029460 - protein, 543 aa, Homo sapiens
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKSLGDCHDHPERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 1029461 - protein, 227 aa, Homo sapiens
MHRDDIAAWGYIRSLGKPGYCCGEERWKAYLALCVFSFEEGGRRKCGQYWPLEKDSRIRFGFLTVTNLGVENMNHYKKTTLEIHNTEERQKRQVTHFQFLSWPDYGVPSSAASLIDFLRVVRNQQSLAVSNMGARSKGQCPEPPIVVHCSAGIGRTGTFCSLDICLAQLEELGTLNVFQTVSRMRTQRAFSIQTPEQYYFCYKAILEFAEKEGMVSSGQNLLAVESQ

SEQ ID NO: 1029462 - protein, 479 aa, Homo sapiens
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKGAFPARLKKVLIVGAPIWFRVPYSIISLLLKDKVRERIQILKTSEVTQHLPRECLPENLGGYVKIDLATWNFQFLPQVNGHPDPFDEIILFSLPPALDWDSVHVPGPHAMTIQELVDYVNARQKQGIYEEYEDIRRENPVGTFHCSMSPGNLEKNRYGDVPCLDQTRVKLTKRSGHTQTDYINASFMDGYKQKNAYIGTQGPLENTYRDFWLMVWEQKVLVIVMTTRFEEGGRRKCGQYWPLEKDSRIRFGFLTVTNLGVENMNHYKKTTLEIHNTEVNPGFFFLTLLKQGENNYCNENLQRE

SEQ ID NO: 1029463 - protein, 193 aa, Homo sapiens
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDRKISRVWWREPEAGEWREPGRWSLPGAKIAPLYSSLGDRLRFCLQRSIHSRRT

SEQ ID NO: 1029464 - protein, 593 aa, Homo sapiens; identical to SEQ ID NO: 1029457

SEQ ID NO: 1029465 - protein, 593 aa, Homo sapiens; identical to SEQ ID NO: 1029457

SEQ ID NO: 1029466 - protein, 583 aa, Homo sapiens; identical to SEQ ID NO: 1029456

SEQ ID NO: 1029467 - protein, 593 aa, Homo sapiens; identical to SEQ ID NO: 1029457

SEQ ID NO: 1029468 - protein, 251 aa, Homo sapiens
MEPATAPRPDMAPELTPEEEQATKQFLEEINKWTVQYNVSPLSWNVAVKFLMARKFDVLRAIELFHSYRETRRKEGIVKLKPHEEPLRSEILSGKFTILNVRDPTGASIALFTARLHHPHKSVQHVVLQALFYLLDRAVDSFETQRNGLVFIYDMCGSNYANFELDLGKKVLNLLKLPSSSTDLEKPQHSSMENIQHLEQTSPKASSLKCDKLLSSFPSKMQQFISGPKCPRSFYQQIKNHSRKTPVISTK

SEQ ID NO: 1029469 - protein, 144 aa, Homo sapiens
SPNSTAWPLSLEPECLPHLHQEKYTPSPSTPADTTRQRERALDSSRDSPPGNTRSLPREERRRTRATRGHSQGPREAMATPEATFCSTEVGENLGTMGPPGQCRTTSAHWQDNISSLAGKSLLRVRGCWGTRGLGKQGNKSSVC

SEQ ID NO: 1029470 - protein, 304 aa, Homo sapiens
MSLMVIIMACVGFFLLQGAWPQEGVHRKPSFLALPGHLVKSEETVILQCWSDVMFEHFLLHREGKFNNTLHLIGEHHDGVSKANFSIGPMMPVLTGTYRCYSSVPHSPYQLSAPSDPLDMVIIGLYEKPSLSAQPGPTVQAGENVSLSCSSRSSYDMYHLSREGEAHERRLPAVRSIHGTFQADFPLGPATHGGTYRCFGSFRDAPYEWSNSSDPLLVSVTGNPSNSWPSPTEPSSKTGNPRHLHVLIGTSVVKIPFTILLFFLLHRWCSDKKNAAVMDQEPAGNRTVNSEDSDEQDHQEVSYA

SEQ ID NO: 1029471 - protein, 267 aa, Homo sapiens
MSLMVIIMACVGFFLLQGAWPQEGVHRKPSFLALPGHLVKSEETVILQCWSDVMFEHFLLHREGKFNDTLHLIGEHHDGVSKANFSIGPMMPVLAGTYRCYGSVPHSPYQLSAPRSSYDMYHLSREGEAHERRLPAVRSINGTFQADFPLGPATHGGTYRCFGSFRDSPYEWSNSSDPLLVSVTGNPSNSWPSPTEPSSKTGNPRHLHVLIGTSVVKIPFTILLFFLLHRWCSDKKNAAVMDQEPAGNRTVNSEDSDEQDHQEVSYA

SEQ ID NO: 1029472 - protein, 105 aa, Homo sapiens
MSLMVIIMACVGFFLLQGAWPQEGVHRKPSFLALPGHLVKSEETVILQCWSDVMFEHFLLHREGKFNNTLHLIGEHHDGVSKANFSIGPMMPVLARDLQMLRLFP

SEQ ID NO: 1029473 - protein, 272 aa, Homo sapiens
MSLMVIIMACVGFFLLQGAWPQEGVHRKPSFLALPGHLVKSEETVILQCWSDVMFEHFLLHREGTYRCYGSVPHSPYQLSAPSDPLDMVIIGLYEKPSLSAQPGPTVQAGENVTLSCSSRSSYDMYHLSREGEAHERRLPAVRSINGTFQADFPLGPATHGGTYRCFGSFRDSPYEWSNSSDPLLVSVTGNPSNSWPSPTEPSSKTGNPRHLHVLIGTSVVKIPFTILLFFLLHRWCSDKKNAAVMDQEPAGNRTVNSEDSDEQDHQEVSYA

SEQ ID NO: 1029474 - protein, 150 aa, Homo sapiens
MSLMVIIMACVGFFLLQGAWPQEGVHRKPSFLALPGHLVKSEETVILQCWSDVMFEHFLLHREGKFNNTLHLIGEHHDGVSKANFSIGPMMPVLAGTYRCYGSVPHSPYQLSAPSDPLDMVIIGQRNIPGRLSSGPCHPRRDLQMLRLFP

SEQ ID NO: 1029475 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKEMSKRSP

SEQ ID NO: 1029476 - protein, 399 aa, Homo sapiens
MKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRQVSPNWGLPSILRPGTPMTQAQPCTVGVPLGMGPGDHWVIPVSPWEHPQLGTCSVPPLPYSYMTVLFYLNNVTGGGETVFPVADNRTYDEMSLIQDDVDLRDTRRHCDKGNLRVKPQQGTAVFWYNYLPDGQGWVGDVDDYSLHGGCLVTRGTKWIANNWINVDPSRARQALFQQEMARLAREGGTDSQPEWALDRAYRDARVEL

SEQ ID NO: 1029477 - protein, 645 aa, Homo sapiens
QAGTGPKSYDHPRSWSTKMQTILFPEARGRLHAGTEKLPLVYALMVPLLSASTLGTLASDLESVQLCPTATQLGKRSPSVGWGSRRRKAEPGADAGGSGRAQHPQAPSPSDRGARGPGGRCPGDCAARAPPRPLPWARARPGCHGGSGGDRPAAETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRYMTVLFYLNNVTGGGETVFPVADNRTYDEMSLIQDDVDLRDTRRHCDKGNLRVKPQQGTAVFWYNYLPDGQGWVGDVDDYSLHGGCLVTRGTKWIANNWINVDPSRARQALFQQEMARLAREGGTDSQPEWALDRAYRDARVEL

SEQ ID NO: 1029478 - protein, 645 aa, Homo sapiens; identical to SEQ ID NO: 1029477

SEQ ID NO: 1029479 - protein, 566 aa, Homo sapiens
QAGTGPKSYDHPRSWSTKMQTILFPEARGRLHAGTEKLPLVYALMVPLLSASTLGTLASDLESVQLCPTATQLGKRSPSVGWGSRRRKAEPGADAGGSGRAQHPQAPSPSDRGARGPGGRCPGDCAARAPPRPLPWARARPGCHGGSGGDRPAAETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRQVSPNWGLPSILRPGTPMTQAQPCTVGVPLGMGPGDHWVIPVSDALTSPHKLFTQWLERGGYWSS

SEQ ID NO: 1029480 - protein, 439 aa, Homo sapiens
QAGTGPKSYDHPRSWSTKMQTILFPEARGRLHAGTEKLPLVYALMVPLLSASTLGTLASDLESVQLCPTATQLGKRSPSVGWGSRRRKAEPGADAGGSGRAQHPQAPSPSDRGARGPGGRCPGDCAARAPPRPLPWARARPGCHGGSGGDRPAAETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQR

SEQ ID NO: 1029481 - protein, 566 aa, Homo sapiens; identical to SEQ ID NO: 1029479

SEQ ID NO: 1029482 - protein, 566 aa, Homo sapiens; identical to SEQ ID NO: 1029479

SEQ ID NO: 1029483 - protein, 645 aa, Homo sapiens; identical to SEQ ID NO: 1029477

SEQ ID NO: 1029484 - protein, 720 aa, Homo sapiens
QAGTGPKSYDHPRSWSTKMQTILFPEARGRLHAGTEKLPLVYALMVPLLSASTLGTLASDLESVQLCPTATQLGKRSPSVGWGSRRRKAEPGADAGGSGRAQHPQAPSPSDRGARGPGGRCPGDCAARAPPRPLPWARARPGCHGGSGGDRPAAETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVRTSLPRQRLQGPARLSPRGPALSPGPHAAPGAALRRSRALPLTRLLSLSGPGRLGPSWQRGLAPQLPAVRLFLEVGHERKVQLVTDRDHFIRTLSLKPLLFEIPGFLTDEECRLIIHLAQMKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRYMTVLFYLNNVTGGGETVFPVADNRTYDEMSLIQDDVDLRDTRRHCDKGNLRVKPQQGTAVFWYNYLPDGQGWVGDVDDYSLHGGCLVTRGTKWIANNWINVDPSRARQALFQQEMARLAREGGTDSQPEWALDRAYRDARVEL

SEQ ID NO: 1029485 - protein, 599 aa, Homo sapiens
QAGTGPKSYDHPRSWSTKMQTILFPEARGRLHAGTEKLPLVYALMVPLLSASTLGTLASDLESVQLCPTATQLGKRSPSVGWGSRRRKAEPGADAGGSGRAQHPQAPSPSDRGARGPGGRCPGDCAARAPPRPLPWARARPGCHGGSGGDRPAAETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRYMTVLFYLNNVTGGGETVFPVADNRTYDEMSLIQDDVDLRDTRRHCDKGNLRVKPQQGTAVFWYNYLPDGQGWVGDVDDYSQPEWALDRAYRDARVEL

SEQ ID NO: 1029486 - protein, 251 aa, Homo sapiens
MDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRYMTVLFYLNNVTGGGETVFPVADNRTYDEMSLIQDDVDLRDTRRHCDKGNLRVKPQQGTAVFWYNYLPDGQGWVGDVDDYSLHGGCLVTRGTKWIANNWINVDPSRARQALFQQEMARLAREGGTDSQPEWALDRAYRDARVEL

SEQ ID NO: 1029487 - protein, 458 aa, Homo sapiens
QAGTGPKSYDHPRSWSTKMQTILFPEARGRLHAGTEKLPLVYALMVPLLSASTLGTLASDLESVQLCPTATQLGKRSPSVGWGSRRRKAEPGADAGGSGRAQHPQAPSPSDRGARGPGGRCPGDCAARAPPRPLPWARARPGCHGGSGGDRPAAETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVRTSLPRQRLQGPARLSPRGPALSPGPHAAPGAALRRSRALPLTRLLSLSGPGRLGPSWQRGLAPQLPAVRLFLRWGTSVRSSWSPTGITSSEPSASSRCSSVSPPDTPGKGQGLRFGGHLEARCDHVTSIVEMAASEQPFQRNTKVKDLPRPRNRVTLPLIPTPCSPFFHHRAGRVSLRLVSKRFIAPVFRATWPP

SEQ ID NO: 1029488 - protein, 105 aa, Homo sapiens [sequence omitted]

SEQ ID NO: 1029489 - protein, 645 aa, Homo sapiens; identical to SEQ ID NO: 1029477

SEQ ID NO: 1029490 - protein, 645 aa, Homo sapiens; identical to SEQ ID NO: 1029477

SEQ ID NO: 1029491 - protein, 338 aa, Homo sapiens
MKGLQRSQILPTEEYEEAMSTMQVSQLDLFRLLDQNRDGHLQLREVLAQTRLGNGWWMTPESIQEMYAAIKADPDGDGVLSLQEFSNMDLRDFHKYMRSHKAESSELVRNSHHTWLYQGEGAHHIMRAIRQRVLRLTRLSPEIVELSEPLQVVRYGEGGHYHAHVDSGPVYPETICSHTKLVANESVPFETSCRYMTVLFYLNNVTGGGETVFPVADNRTYDEMSLIQDDVDLRDTRRHCDKGNLRVKPQQGTAVFWYNYLPDGQGWVGDVDDYSLHGGCLVTRGTKWIANNWINVDPSRARQALFQQEMARLAREGGTDSQPEWALDRAYRDARVEL

SEQ ID NO: 1029492 - protein, 566 aa, Homo sapiens; identical to SEQ ID NO: 1029479

SEQ ID NO: 1029493 - protein, 309 aa, Homo sapiens
QAGTGPKSYDHPRSWSTKMQTILFPEARGRLHAGTEKLPLVYALMVPLLSASTLGTLASDLESVQLCPTATQLGKRSPSVGWGSRRRKAEPGADAGGSGRAQHPQAPSPSDRGARGPGGRCPGDCAARAPPRPLPWARARPGCHGGSGGDRPAAETAAAEEASRPQWAPPDHCQAQAAAGLGDGEDAPVRPLCKPRGICSRAYFLVLMVFVHLYLGNVLALLLFVHYSNGDESSDPGPQHRAQGPGPEPTLGPLTRLEGIKVGHERKVQLVTDRDHFIRTLSLKPLLFASPVSPAATAPAPSLPSVPWP

SEQ ID NO: 1029494 - protein, 359 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 1029495 - protein, 341 aa, Homo sapiens
MAAVSGLVRRPLREVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 1029496 - protein, 359 aa, Homo sapiens; identical to SEQ ID NO: 1029494

SEQ ID NO: 1029497 - protein, 418 aa, Homo sapiens
AAPGRGPRPTHTPPLAPPRGPFTRWAGGRVIAMRAPCHWPAPVEAGLLTSAGPSVVVWQRIEDTTKMAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGISKKLVLEYSQAIVNIMYLNTYRIKRLKARSGQTTSTLNL

SEQ ID NO: 1029498 - protein, 317 aa, Homo sapiens
AAPGRGPRPTHTPPLAPPRGPFTRWAGGRVIAMRAPCHWPAPVEAGLLTSAGPSVVVWQRIEDTTKMAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGRLPHSSAHWNEVELKTL

SEQ ID NO: 1029499 - protein, 249 aa, Homo sapiens [sequence omitted]

SEQ ID NO: 1029500 - protein, 352 aa, Homo sapiens
AAPGRGPRPTHTPPLAPPRGPFTRWAGGRVIAMRAPCHWPAPVEAGLLTSAGPSVVVWQRIEDTTKMAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIEGRTLYWGPSKRGRLTRAQKGRGGNPPDTAARPAHTPGAHGTHRKSTARRGHKHTK

SEQ ID NO: 1029501 - protein, 434 aa, Homo sapiens
AAPGRGPRPTHTPPLAPPRGPFTRWAGGRVIAMRAPCHWPAPVEAGLLTSAGPSVVVWQRIEDTTKMAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGISKKLVLEYSQAIVNIMYLNTYRIKRLKARSGQTTSTLNLSCVQFPGCSCCSCHWC

SEQ ID NO: 1029502 - protein, 453 aa, Homo sapiens
AAPGRGPRPTHTPPLAPPRGPFTRWAGGRVIAMRAPCHWPAPVEAGLLTSAGPSVSRLAADRGHDQDGGGVWLGAETPSGGRQQRAACIPTRPLPTLRPAVIFLSPCQVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 1029503 - protein, 306 aa, Homo sapiens
GSVNNPLVSISETRGLLTLPSVAWEGEFIVLFCISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 1029504 - protein, 225 aa, Homo sapiens
VNYKFDKKQAVTVRIPGCSVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 1029505 - protein, 155 aa, Homo sapiens [sequence omitted]

SEQ ID NO: 1029506 - protein, 359 aa, Homo sapiens; identical to SEQ ID NO: 1029494

SEQ ID NO: 1029507 - protein, 359 aa, Homo sapiens; identical to SEQ ID NO: 1029494

SEQ ID NO: 1029508 - protein, 453 aa, Homo sapiens; identical to SEQ ID NO: 1029502

SEQ ID NO: 1029509 - protein, 317 aa, Homo sapiens
MDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 1029510 - protein, 156 aa, Homo sapiens
MLYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 1029511 - protein, 489 aa, Homo sapiens
MEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRWRPLPGPHRSHRRGCRGGSFKCCSGAIIVLTKSGRSAHQVARYRPSAPIIAVTLGIPDSIRSCGPPVPVGIFPVLGAHGPMSRMCLWLEDVDLRVNFCHECLAMPEASSSKGDVRHMCLTWMCALGSRISPSSHAVYVPCACNWTPKMSPPSYDLEPEQTLTGHNPQGATNDGSKPGGRRTEAQESKARRRRRRDRTAQDRKTRRENQERHHGQARQEESEYDHNRRRSECTEQSER

SEQ ID NO: 1029512 - protein, 520 aa, Homo sapiens
REYFLKEEISSLGFKGRIGVCLVKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRWRPLPGPHRSHRRGCRGGSFKCCSGAIIVLTKSGRSAHQVARYRPSAPIIAVTLGSPDSIRSCGPPVPVGIFPVLGAHGPMSRMCLWLEDVDLRVNFCHECLAMPEASSSKGDVRHMCLTWMCALGSRISPSSHAVYVPCACNWTPKMSPPSYDLEPEQTLTGHNPQGATNDGSKPGGRRTEAQESKARRRRRRDRTAQDRKTRRENQERHHGQARQEESEYDHNRRRSECTEQSER

SEQ ID NO: 1029513 - protein, 488 aa, Homo sapiens
MEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRWRPLPGPHRSHRRGCRGGSFKCCSGAIIVLTKSGRSAHQVARYRPSAPIIAVTLGIPDSIRHVAHLYRGIFPVLGAHGPMSRMCLWLEDVDLRVNFCHECLAMPEASSSKGDVRHMCLTWMCALGSRISPSSHAVYVPCACNWTPKMSPPSYDLEPEQTLTGHNPQGATNDGSKPGGRRTEAQESKARRRRRRDRTAQDRKTRRENQERHHGQARQEESEYDHNRRRSECTEQSER

SEQ ID NO: 1029514 - protein, 503 aa, Homo sapiens
MVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETKQKEQIESLTEVHRRELNDVISIWEKKLNQQAEELQEIHEIQLQEKEQEVAELKQKILLFGCEKEEMNKEITWLEGKNVLSRIPPLT

SEQ ID NO: 1029515 - protein, 954 aa, Homo sapiens
RSELVTAYQMLQREKKKLQGILSQSQDKSLRRIAELREELQMDQQAKKHLQEEFDASLEEKDQYISVLQTQVSLLKQRLRNGPMNVDVLKPLPQLEPQAEVFTKEENPESDGEPVVEDGTSVKTLETLQQRVKRQENLLKRCKETIQSHKEQCTLLTSEKEALQEQLDERLQELEKIKDLHMAEKTKLITQLRDAKNLIEQLEQDKGMVIAETKRQMHETLEMKEEEIAQLRSRIKQMTTQGEELREQKEKSERAAFEELEKALSTAQKTEEARRKLKAEMDEQIKTIEKTSEEERISLQQELSRVKQEVVDVMKKSSEEQIAKLQKLHEKELARKEQELTKKLQTREREFQEQMKVALEKSQSEYLKISQEKEQQESLALEELELQKKAILTESENKLRDLQQEAETYRTRILELESSLEKSLQENKNQSKDLAVHLEAEKNKHNKEITVMVEKHKTELESLKHQQDALWTEKLQVLKQQYQTEMEKLREKCEQEKETLLKDKEIIFQAHIEEMNEKTLEKLDVKQTELESLSSELSEVLKARHKLEEELSVLKDQTDKMKQELEAKMDEQKNHHQQQVDSIIKEHEVSIQRTEKALKDQINQLELLLKERDKHLKEHQAHVENLEADIKRSEGELQQASAKLDVFQSYQSATHEQTKAYEEQLAQLQQKLLDLETERILLTKQVAEVEAQKKDVCTELDAHKIQVQDLMQQLEKQNSEMEQKVKSLTQVYESKLEDGNKEQEQTKQILVEKENMILQMREGQKKEIEILTQKLSAKEDSIHILNEEYETKFKNQEKKMEKVKQKAKEMQETLKKKLLDQEAKLKKELENTALELSQKEKQFNAKMLEMAQANSAGISDAVSRLETKQKEQIESLTEVHRRELNDVISIWEKKLNQQAEELQEIHEIQLQEKEQEVAELKQKILLFGCEKEEMNKEITWLEGKNVLSRIPPLT

SEQ ID NO: 1029516 - protein, 154 aa, Homo sapiens
SSGAATAPHPLKMFSCSKFVSTSLLGQEHLTAAEAVRYLAVVLKRPEILTDESLSSLAVSCPLTSLVYSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 1029517 - protein, 112 aa, Homo sapiens
MRVQIGKSDIRFDALILVPLIPSLVYSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 1029518 - protein, 178 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARALVVRTTSSPCSTGYCEATHRGCHCGEGLYFNP

SEQ ID NO: 1029519 - protein, 325 aa, Homo sapiens
MAAAAASLRGVVLGPRGAGLPGARARGLLCSARPGQLPLRTPQAVALSSKSGLSRGRKVMLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARHGGEDYVFSLLTGYCEPPTGVSLREGLYFNPYFPGQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 1029520 - protein, 188 aa, Homo sapiens
CVPGLPGKCNGEEIVDHNAVQRHWPVGTSDISVLMHDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARALVVRTTSSPCSTGYCEATHRGCHCGEGLYFNP

SEQ ID NO: 1029521 - protein, 107 aa, Homo sapiens
GGFDSRGSPRADGSGGRAEEAKMAAAAASLRGVVLGPRGGGAPGRACPGSAVQRAARAAPATDTSGSGLVVEVWPFPRPESDAVSAGHAGGRGCGAGRGSAFGCECQ

SEQ ID NO: 1029522 - protein, 97 aa, Homo sapiens
GALRIPPSDGYARPVRMPNEDGEMFMRPGKLFDYFPKPYPNSEAARAANNGALPPDLSYIVRARALVVRTTSSPCSTGYCEATHRGCHCGEGLYFNP

SEQ ID NO: 1029523 - protein, 107 aa, Homo sapiens; identical to SEQ ID NO: 1029521

SEQ ID NO: 1029524 - protein, 265 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARYTGCPWGGAGEMGEGLTCAVELRSHGSGPEGIGGEDYVFSLLNGLLRSHPPGLSLRGRSLLQPLTFLAQAIAMAPPIYTDVLEFDDGTPATMSQIAKDVCTFLRWASEPEHDHRKRMGLR

SEQ ID NO: 1029525 - protein, 184 aa, Homo sapiens
MGAVPTPQKVAGPILSTPKREGAWSSGENWVGKTSPGGTTKKLSALGRQEAPTRRSMGGAPNFADEEAPSHGVFVSIEGEDPPSAGLVTLVLNDCREGTIGSLRGREDVDEHSRNDQTAGSKKRPQRPVLFPLVPQVLRERPDSGDSVTQWGKMAGLCRKKVGVHRVPPGSPQGCGHHKVGPED

SEQ ID NO: 1029526 - protein, 178 aa, Homo sapiens; identical to SEQ ID NO: 1029518

SEQ ID NO: 1029527 - protein, 178 aa, Homo sapiens; identical to SEQ ID NO: 1029518

SEQ ID NO: 1029528 - protein, 111 aa, Homo sapiens
MDFVAYRHLVGVCYTEDEAKELAAEVEVQDGPNEDGEMFMRPGKLFDYFPKPYPNSEAARAANNGALPPDLSYIVRARALVVRTTSSPCSTGYCEATHRGCHCGEGLYFNP

SEQ ID NO: 1029529 - protein, 163 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEADGEMFMRPGKLFDYFPKPYPNSEAARAANNGALPPDLSYIVRARALVVRTTSSPCSTGYCEATHRGCHCGEGLYFNP

SEQ ID NO: 1029530 - protein, 299 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARYTGCPWGGAGEMGEGLTCAVELRSHGSGPEGIGGEDYVFSLLNGLLRSHPPGLSLRGRSLLQPLTFLAQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 1029531 - protein, 264 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARALVVRTTSSPCSTGYCEATHLFISLIFYFNPYFFFFFMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 1029532 - protein, 110 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEWPLPSTQMS

SEQ ID NO: 1029533 - protein, 113 aa, Homo sapiens
MLSALGMLAAGGAGLAVALHSAVSASDRGCLHTPPAYPVVSPRGLLSSLDHTSIRRGFQVYKQVCASCHSMDFVAYRHLVGVCYTEDEAKELAAEVEVQDGPNEWPLPSTQMS

SEQ ID NO: 1029534 - protein, 103 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEAYRKLGFRKVGGKKPAPN

SEQ ID NO: 1029535 - protein, 325 aa, Homo sapiens; identical to SEQ ID NO: 1029519

SEQ ID NO: 1029536 - protein, 325 aa, Homo sapiens; identical to SEQ ID NO: 1029519

SEQ ID NO: 1029537 - protein, 325 aa, Homo sapiens; identical to SEQ ID NO: 1029519

SEQ ID NO: 1029538 - protein, 178 aa, Homo sapiens; identical to SEQ ID NO: 1029518

SEQ ID NO: 1029539 - protein, 178 aa, Homo sapiens; identical to SEQ ID NO: 1029518

SEQ ID NO: 1029540 - protein, 107 aa, Homo sapiens; identical to SEQ ID NO: 1029521

SEQ ID NO: 1029541 - protein, 83 aa, Homo sapiens
LEFDDGRGHGNGLARKLFDYFPKPYPNSEAARAANNGALPPDLSYIVRARALVVRTTSSPCSTGYCEATHRGCHCGEGLYFNP

SEQ ID NO: 1029542 - protein, 331 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARYTGCPWGGAGEMGEGLTCAVELRSHGSGPEGIGGEDYVFSLLNGLLRSHPPGLSLRGRSLLQPLTFLAQAIAMAPPIYTDVLEFDDGTPATMSQIAKDVCTFLRWASEPEHDHRKRMGLKVKGLGGHGGYQRRAGSWAGLLPTPFSEPSLLQMLMMMALLVPLVYTIKRHKWSVLKSRKLAYRPPK

SEQ ID NO: 1029543 - protein, 131 aa, Homo sapiens
MLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYQKLAGRGGGCL

SEQ ID NO: 1029544 - protein, 171 aa, Homo sapiens
ARALTKAQLGLELEELEAAALLVQEEETALKAAHSVSGQQTLCSSSEASDSEDSDSSVSSGNEDSGSDSEQDELKDSPSETVSSLQGPFLEESSAFLIVDGGVRRNTAIQESDASQGKPLASSWPLGVSGPLIEELGEQLKTTVQVSEPKGTTAVNRSNIQERDGCQTPNN

SEQ ID NO: 1029545 - protein, 171 aa, Homo sapiens; identical to SEQ ID NO: 1029544

SEQ ID NO: 1029546 - protein, 356 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVSEGL

SEQ ID NO: 1029547 - protein, 287 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGGPWLCH

SEQ ID NO: 1029548 - protein, 423 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 1029549 - protein, 423 aa, Homo sapiens; identical to SEQ ID NO: 1029548

SEQ ID NO: 1029550 - protein, 403 aa, Homo sapiens
MGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 1029551 - protein, 339 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGGEPHFSSEPHCHPCWALFPYLDKGRRRVVKETPKDLAALTSEGSWAQQATAGRDDECI

SEQ ID NO: 1029552 - protein, 241 aa, Homo sapiens
MSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 1029553 - protein, 126 aa, Homo sapiens
MGSNSEVARLLASSDPLAQIAEDKPYAELWMGTHPRGDAKILDNRISQKTLSQWIAENQDSLGSKVKDTFNGNLPFLFKVLSVETPLSIQAHPHPPDGTGDSDSQHTHNPDTNPSATWWRALHWGQ

SEQ ID NO: 1029554 - protein, 119 aa, Homo sapiens
MGSNSEVARLLASSDPLAQIAEDKPYAELWMGTHPRGDAKILDNRISQKTLSQWIAENQDSLGSKVKDTFNGNLPFLFKVLSVETPLSIQAHPAHPQPRHQSLCNVVACSSLGPMRVSH

SEQ ID NO: 1029555 - protein, 110 aa, Homo sapiens [sequence omitted]

SEQ ID NO: 1029556 - protein, 403 aa, Homo sapiens; identical to SEQ ID NO: 1029550

SEQ ID NO: 1029557 - protein, 362 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKTAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 1029558 - protein, 148 aa, Homo sapiens [sequence omitted]

SEQ ID NO: 1029559 - protein, 126 aa, Homo sapiens; identical to SEQ ID NO: 1029553

SEQ ID NO: 1029560 - protein, 423 aa, Homo sapiens; identical to SEQ ID NO: 1029548

SEQ ID NO: 1029561 - protein, 261 aa, Homo sapiens
PLFWCEMGPEGGEGTRKLLSLQPQSAPRFRRVPLLGLGILRCLGAGEAGASSLLLGCRFEIALSPLTRPVLASGCPSFCLLFFLPSVCFLSLGMSISLFPILAVSVCFPLAAFPTWLCPSASVFLCLFVSRSLPPHLSISLCLSLLMPLFVSVFISVSPQPHSPALFLFSGLLPLGTEAAQQGAPETPRGTAGGPHPGSPPHARQLRAVWIFPLAAVGRGGAPGKGRHRAQHLREPRGPWTPLPFIKGAGSRGTEMIMISV

SEQ ID NO: 1029562 - protein, 396 aa, Homo sapiens
MELDHRTSGGLHAYPGPRGGQVAKPNVILQIGKCRAEMLEHVRRTHRHLLAEVSKQVERELKGLHRSVGKLESNLDGYVPTSDSQRWKKSIKACLCRCQETIANLERWVKREMHVWREVFYRLERWADRLESTGGKYPVGSESARHTVSVGVGGPESYCHEADGYDYTVSPYAITPPPAAGELPGQEPAEAQQYQPWVPGEDGQPSPGVDTQIFEDPREFLSHLEEYLRQVGGSEEYWLSQIQNHMNGPAKKWWEFKQGSVKNWVEFKKEFLQYSEGTLSREAIQRELDLPQKQGEPLDQFLWRKRDLYQTLYVDADEEEIIQYVVGTLQPKLKRFLRHPLPKTLEQLIQRGMEVQDDLEQAAEPAGPHLPVEDEAETLTPAPNSESVASDRTQPE

SEQ ID NO: 1029563 - protein, 76 aa, Homo sapiens
STDLTQRQMDRHSRTSDREPLLTQEENKKIRQQQQQSRPDVPVLPGPSAPVIHARLEKNQSSAHDSPMAGGGSQRG

SEQ ID NO: 1029564 - protein, 464 aa, Homo sapiens
IRARGSSLRSSRAGPASPGVLRRPRRRPAATDRRSPQLRTGPRPPDPSAGPPSVRPEEFAACRSTCAQMELDHRTSGGLHAYPGPRGGQVAKPNVILQIGKCRAEMLEHVRRTHRHLLAEVSKQVERELKGLHRSVGKLESNLDGYVPTSDSQRWKKSIKACLCRCQETIANLERWVKREMHVWREVFYRLERWADRLESTGGKYPVGSESARHTVSVGVGGPESYCHEADGYDYTVSPYAITPPPAAGELPGQEPAEAQQYQPWVPGEDGQPSPGVDTQIFEDPREFLSHLEEYLRQVGGSEEYWLSQIQNHMNGPAKKWWEFKQGSVKNWVEFKKEFLQYSEGTLSREAIQRELDLPQKQGEPLDQFLWRKRDLYQTLYVDADEEEIIQYVVGTLQPKLKRFLRHPLPKTLEQLIQRGMEVQDDLEQAAEPAGPHLPVEDEAETLTPAPNSESVASDRTQPE

SEQ ID NO: 1029565 - protein, 396 aa, Homo sapiens; identical to SEQ ID NO: 1029562

SEQ ID NO: 1029566 - protein, 346 aa, Homo sapiens
MRDLFARQEGPLYVLLSRSWTRRARPRSSEHEIAKTEGLEMADHMMAMNHGTTSPDAHAYGLHRYTLTHRHGDIGAVSRAPITDLAVSSPSNAFNALMGEHIHYGAGNMNATSGIRHAMGAGDCATGGHPSERAGPRGHVSLTPSSVGPRWPAMGRLPAGQHAAAEAQQGSISTITPTPTNQYMPECAPCLQGQQMNGTNQHFRDCKPKHSGGTSTPGGSVRTKSNTRRLWHQLERRPRSQPATASCRQPSTQTNIARPHEAPKYHDANADAPHVHRHCMTSTDGKVIIPTAIPTGLGPTQGSQTDTRVATNRDDTHDGTPRANRTPSRRHHCTDQTPEQRHHPHQ

SEQ ID NO: 1029567 - protein, 73 aa, Homo sapiens
QQPRTPILLIRDKPATARPNADGRLIWSHRWPPSPPPVTGSKLATRHLGARSMASRAENQTAPGEVPALSPAV

SEQ ID NO: 1029568 - protein, 256 aa, Homo sapiens
LSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVLHEWSWAFLKIDNGTPWGTATDSYIEVLDMVPVSTLKTYEWDRKMAVDALENECNQSEDGNPAGALGRNLGETRATERLGLDAWEKKLERRYGDKHSLLTREKGA

SEQ ID NO: 1029569 - protein, 291 aa, Homo sapiens
LRICSYGSDWESQKLNRSQEKRSQRSRENDLNQNGFGFPLDVVAKGIFKALHDPRLTQAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVLHEWCWAFLKIDNGSPWGTATDSYIEVLDMVPVSNLKTYEWDRKMAVDALEIRVQISPRMAILQEPLEEILVKPELTERLGLDAWEKKLERRYGDKHSLLTREKGA

SEQ ID NO: 1029570 - protein, 303 aa, Homo sapiens
MKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 1029571 - protein, 66 aa, Homo sapiens
PRHPSSASTCVSKTGLQIPQPAPPKIYFPIRESWNAGMTVMSALSVAPSKAEYSKEGWEYVKARTK

SEQ ID NO: 1029572 - protein, 337 aa, Homo sapiens
MLRNNLGNSSDSKNEDGSVFSQTEHNIVATYLIMAGMISIISNIIVLGIFIKYKELRTPTNAIIINLAVTDIGVSSIGYPMSAASDLYGSWKFGYAGCQVYAGLNIFFGMASIGLLTVVAVDRYLTICLPDVGRRMTTNTYIGLILGAWINGLFWALMPIIGWASYAPDPTGATCTINWRKNDRSFVSYTMTVIAINFIVPLTVMFYCYYHVTLSIKHHTTSDCTESLNRDWSDQIDVTKMSVIMICMFLVAWSPYSIVCLWASFGDPKKIPPPMAIIAPLFAKSSTFYNPCIYVVANKKFRRAMLAMFKCQTHQTMPVTSILPMDVSQNPLASGRI

SEQ ID NO: 1029573 - protein, 30 aa, Homo sapiens
MRRRCPEFRTLSITLPFNLDVKTGLNSTRK

SEQ ID NO: 1029574 - protein, 41 aa, Homo sapiens
MVTSRERGTTRLPKEGEPTQSGNGAKSNSRADHSEPCDTSS

SEQ ID NO: 1029575 - protein, 77 aa, Homo sapiens
MPGEFFNFLSTLGVTMSPRLVSNFWAQAVLTPWPPKRVGITGMSVLKLAFVSLRLECSGAIMAHCLNFPDPGDFSHS

SEQ ID NO: 1029576 - protein, 88 aa, Homo sapiens
APRYGLTQKNNRELEKPKKVHVTEDMKHENNATGVRSHQHLGGQGWEDRLSPGVLGCSALCRSGVRTKFGINMVTSRERGTTRLPKEG

SEQ ID NO: 1029577 - protein, 168 aa, Homo sapiens
MARPWLTVTSTSRVQVILSASASRVAGTTVHAPPCPDNFVFLVETGFLHVGQAVLKLPISGDLPASASQSARITGANHHAQPETHFFVCSLFCFRDRVSLFVPMLECSALCRSGVRTKFGINMVTSRERGTTRLPKVWLHQVTRIGHRNSPIPSLLNIVTAIADTFTS

SEQ ID NO: 1029578 - protein, 123 aa, Homo sapiens
MARPWLTVTSTSRVQVILSASASRVAGTTVHAPPCPDNFVFLVETGFLHVGQAVLKLPISGDLPASASQSARITGANHHAQPETHFFVCSLFCFRDRVSLFCPCWNAVRYADRVSALSSASIW

SEQ ID NO: 1029579 - protein, 145 aa, Homo sapiens
AAAGALILFRGPKNHKHMLNLTVYSSYNCQNLFSSSYLTHIAGSWHPGGGRNGPGAPGGPVDPYRTFHSGPVGLLVHLNKSESCGLHAPGTWWKAPCYETVKVWLQENLLAVGIFGLCTALVQILGLTFAMTMYCQVVKADTYCA

SEQ ID NO: 1029580 - protein, 238 aa, Homo sapiens
MARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 1029581 - protein, 238 aa, Homo sapiens; identical to SEQ ID NO: 1029580

SEQ ID NO: 1029582 - protein, 174 aa, Homo sapiens
MAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 1029583 - protein, 174 aa, Homo sapiens
MARACLQAVKYLMFAFNLLFWFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 1029584 - protein, 394 aa, Homo sapiens
PQRAGRADVWVPPPGSERIRATRCHRGGQSGSRSGAGAGAGRRDGAFRGGGCGALSGGPGTPGAMRRSSTDESTYRRSPSPEGKEPDFARGGPFRRYSSLYGRAGGGDAGGAFFGLHANPGPKAAQARYTSPKGNKYVVFYLDLSFIFLLELKRCGMARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 1029585 - protein, 294 aa, Homo sapiens
GGVPGACEGRAARVPWPEVSDRERLEPDASGAREFEPRADTQQQELGASLVAPTTCLPTGQPSGTLSTAWSLSCGQPLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 1029586 - protein, 354 aa, Homo sapiens
AGCSPSRAPDAQTRLWARGEGTREEVGEGVVEEVLFELNLEDPGTGDPWADSRRLHWQDPLKASALACPGAQGLRTTRDEEPVSLGWSAGGLAPAPFLLCPWGGELGASLVAPTTCLPTGQPSGTLSTAWSLSCGQPLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 1029587 - protein, 264 aa, Homo sapiens
MARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDVRRGQVGGVGGCPLPSCLSPPELDPQFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 1029588 - protein, 145 aa, Homo sapiens; identical to SEQ ID NO: 1029579

SEQ ID NO: 1029589 - protein, 238 aa, Homo sapiens; identical to SEQ ID NO: 1029580

SEQ ID NO: 1029590 - protein, 238 aa, Homo sapiens; identical to SEQ ID NO: 1029580

SEQ ID NO: 1029591 - protein, 238 aa, Homo sapiens; identical to SEQ ID NO: 1029580

SEQ ID NO: 1029592 - protein, 238 aa, Homo sapiens; identical to SEQ ID NO: 1029580

SEQ ID NO: 1029593 - protein, 255 aa, Homo sapiens
FLRRSLTLSPRLECSGTMSAHCKLRLLGSRHSPVAVPQLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 1029594 - protein, 156 aa, Homo sapiens
AGRKAAAAVRVSRVRLTDSCAAGAGGASGRRRRRAWGFLGRTHHLPAHWSAFRDPEHRLVSFLWPAPGRLWRAGCRHLAGRHTGELRHAVLFLPVPVGCQPAHHHRRLCHGHRLRGLPGCHQGEQVPPAHFLPAAAAGVPAGGHHRHPLLRLHGQD

SEQ ID NO: 1029595 - protein, 717 aa, Homo sapiens
RRASPPRVPPAARPGVTASCPPARLPACPPTRLPAYPAYPPAGLPSFQRRAMEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRFFPGDSAGLFPTSPSLAIPHPSVGGSPASLFIPSPPSFLPLANQQLFRSPRRTSPSSLPGRLSRALSLGTIPSLTRADSGYLFSGSRPPSQVSRSGEFPVSDYFSLLSGKLPLLPIPSPAPSVAGSVASSSGSLRHRRPLISPARLNLKGQKLLLFPSPPGEAPTTPSSSDEHSPHNGSLFTMEPPHVPRKPPLQDVKHALDLRSKLERGSACSNRSIKKEDDSSQSSTCVVDTTTRGCSEEAATWRGRFGPSLVRGLLAVSLAANALFTSVFLYQSLR

SEQ ID NO: 1029596 - protein, 854 aa, Homo sapiens
RRASPPRVPPAARPGVTASCPPARLPACPPTRLPAYPAYPPAGLPSFQRRAMEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRSEKQHDCGGRTHGCSGPGFARSEAGPSLSCLFSPAHALPPRTLQPQVLAQSLHCLEESVCPAFSFRAPPAIPECPVATHHCCHLSGQWPFHWPGDWNVGSAHTGSGPWLPTGSSRHPPLTTPFAGSDTSWVRVLVLLSSLLLQDPPESPEMESAVLGPSLAFAMSLGSETPPETGSEEPVLTLGNLSFSKGEGAQGMQAFSDIRSLSSFPSLTCHEPLQVPAHHGPAPLCPPTQVRGQPTDLLLSSRAWPGPCCSQPQFAIYEMRWTPLHSPWVPAQWVWGSHEVAHEDTLWKSRGCHVQRKFPAWGLYPGVPVESGPRPSLTGHVPSGCPLPQGPHVLPLATLSTSSPSRCGQVCQLLSPVRWNPGGGKSRSQVHEGYTRHLGLPGWVGGAGARPHCCESATPGGPRGCPTPVIG

SEQ ID NO: 1029597 - protein, 612 aa, Homo sapiens
RRASPPRVPPAARPGVTASCPPARLPACPPTRLPAYPAYPPAGLPSFQRRAMEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRSEKQHDCGGRTHGCSGPGFARSEAGPSLSCLFSPAHALPPRTLQPQVLAQSLHCLEESVCPAFSFRAPPAIPECPVATTTAATSLANGPFTGLVTGMWAAPTQALAHGFLLAAPGTPLSPRRLLALTLLGEGPGPAVFPPGLCTGVVTVATGWALACLTVQQSEAGAAESPNSP

SEQ ID NO: 1029598 - protein, 717 aa, Homo sapiens; identical to SEQ ID NO: 1029595

SEQ ID NO: 1029599 - protein, 307 aa, Homo sapiens
MCLPCSVPGSRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029600 - protein, 296 aa, Homo sapiens
GESSSIFLILFLSSTNALFVSNFIYVLYRSCYISPPKSHKSKERAGGGRGTCNCIGDCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029601 - protein, 1273 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGAGKDAGRLCGLHPPLTFTCIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029602 - protein, 1216 aa, Homo sapiens
MRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029603 - protein, 841 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDTSRPAAHITQEVFTLNSKPGSPSQDTGVKAQ

SEQ ID NO: 1029604 - protein, 717 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQSRCPRPGCAPSRAHPLPRAGRPAGTRAKGSPRPRSAPRPRCRPRGPSSLPDRKSTSRPRPPRRRGRRCQSRARRCCTSSTPRAATTATTPSSRITASTGRRRGHQGL

SEQ ID NO: 1029605 - protein, 471 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029606 - protein, 234 aa, Homo sapiens
ILLLVLCSLKFRRLIVVRVFGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029607 - protein, 1296 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVSSWLHCWVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029608 - protein, 1317 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLVSQVMCSCWSRELPLGTTDLEEIRTLAEKGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029609 - protein, 972 aa, Homo sapiens
MCLEHNGDRPYWLNEWMNELMNFFSLEVLQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029610 - protein, 735 aa, Homo sapiens
TRPGHPATITLQPGSSSCPPPAPKLVRPGSAGLLTRGPGMFLFQEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029611 - protein, 1090 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFGKSSNPGWERWLTPVIPALEEAEAGGSRDQEMETILANTVKPRLYLKKYKKFSRVWWRVPVVSATWEAEGKDCLTQEVEAAVSHDRTTALQAWVTERDSVSKTKQDKTIWCHSVNLQCYTSLSSSETFVSPQRKTQKPLSSHAPMSSPLDMCLPCSVPGSRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029612 - protein, 695 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMNPLHRHLPCPPSPPRWCLFPKGEQKVSSSIR

SEQ ID NO: 1029613 - protein, 307 aa, Homo sapiens; identical to SEQ ID NO: 1029599

SEQ ID NO: 1029614 - protein, 1288 aa, Homo sapiens
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029615 - protein, 1255 aa, Homo sapiens
MQDDCITSRLWRYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029616 - protein, 1051 aa, Homo sapiens
LCDSRVDSLLENHALCAAGAREAQWPHEGRTPEVAQPCRQGVLGGGSLAKAQAENRSVTHLFSSKVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQVRCATRGFVCICVCVCMRECVCVYLCICVCMCVCTHAYVRACVNACMCTHASDGPGNCSMRRESQDLNPGLPVPHIPDPALPLQQLLKGRKAGLWINLV

SEQ ID NO: 1029617 - protein, 93 aa, Homo sapiens
GALLSQLKMADESETAVKPPAPPLPQMMEGNGNGHEHCSDCENEEDNSYNRGGLSPANDTGAKKKKKKQKKKKEKGSETDSAQDQPVKMNSLP

SEQ ID NO: 1029618 - protein, 61 aa, Homo sapiens
GALLSQLKMADESETAVKPPAPPLPQMMEGNGNGHEHCSDCENEEDNSYNRGMNSLPAERI

SEQ ID NO: 1029619 - protein, 199 aa, Homo sapiens
GHAWENQKGLHLDYKIDQQAQLQSLHIEWWVRNADVQVFEGKPPCVQEGVPAPSNNQGKGRSYSRPSWSCSTRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 1029620 - protein, 155 aa, Homo sapiens
GHAWENQKGLHLDYKIDQQAQLQSLHIEWWVRNADVQVFEGKPPCVQEGVPAPSNNQGKGRSYSRPSWSCSTRGTPTPRGVLSTRGPVSRGRGLLTPRARGVPPTGYRPPPPPPTQETYGEYDYDDGYGTAYDEQSYDSYDNSYSTPAQRARRVD

SEQ ID NO: 1029621 - protein, 100 aa, Homo sapiens
YPRFFFEGGSLAADDLLIFPPLQDYDDGYGTAYDEQSYDSYDNSYSTPAQSGADYYDYGHGLSEETYDSYGQEEWTNSRHKAPSARTAKGVYRDQPYGRY

SEQ ID NO: 1029622 - protein, 97 aa, Homo sapiens
QSVIWIHKYTSYLRYLSQNNDYDDGYGTAYDEQSYDSYDNSYSTPAQSGADYYDYGHGLSEETYDSYGQEEWTNSRHKAPSARTAKGVYRDQPYGRY

SEQ ID NO: 1029623 - protein, 94 aa, Homo sapiens
LTSLNLITVLSFYPPLQDYDDGYGTAYDEQSYDSYDNSYSTPAQSGADYYDYGHGLSEETYDSYGQEEWTNSRHKAPSARTAKGVYRDQPYGRY

SEQ ID NO: 1029624 - protein, 92 aa, Homo sapiens
FITIFGKVTKRSTPKDYDDGYGTAYDEQSYDSYDNSYSTPAQSGADYYDYGHGLSEETYDSYGQEEWTNSRHKAPSARTAKGVYRDQPYGRY

SEQ ID NO: 1029625 - protein, 97 aa, Homo sapiens; identical to SEQ ID NO: 1029622

SEQ ID NO: 1029626 - protein, 199 aa, Homo sapiens; identical to SEQ ID NO: 1029619

SEQ ID NO: 1029627 - protein, 160 aa, Homo sapiens
GHAWENQKGLHLDYKIDQQAQLQSLHIEWWVRNADVQVFEGKPPCVQEGVPAPSNNQGKGRSYSRPSWSCSTRGTPTPRGVLSTRGPVSRGRGLLTPRARGVPPTGYRPPPPPPTQETYGEYDYDDGYGTAYDEQSYDSYDNSYSTPAQIIFFYEQSLFK

SEQ ID NO: 1029628 - protein, 119 aa, Homo sapiens
MEIPGGYQKFLPKRPSQLIVTSQGFDTQSEIRRSDFLITPAPDYDDGYGTAYDEQSYDSYDNSYSTPAQSGADYYDYGHGLSEETYDSYGQEEWTNSRHKAPSARTAKGVYRDQPYGRY

SEQ ID NO: 1029629 - protein, 100 aa, Homo sapiens; identical to SEQ ID NO: 1029621

SEQ ID NO: 1029630 - protein, 439 aa, Homo sapiens
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPSLSWLRDAYREFDRKYKKNIKALYIVHPTMFIKTLLILFKPLISFKFGQKIFYVNYLSELSEHVKLEQLGIPRQVLKYDDFLKSTQKSPATAPKPMPPRPPLPNQQFGVSLQHLQEKNPEQEPIPIVLRETVAYLQAHALTTEGIFRRSANTQVVREVQQKYNMGLPVDFDQYNELHLPAVILKTFLRELPEPLLTFDLYPHVVGFLNIDESQRVPATLQVLQTLPEENYQVLRFLTAFLVQISAHSDQNKMTNTNLAVVFGPNLLWAKDAAITLKAINPINTFTKFLLDHQGELFPSPDPSGL

SEQ ID NO: 1029631 - protein, 435 aa, Homo sapiens
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPSLSWLRDAYREFDRKYKKNIKALYIVHPTMFIKTLLILFKPLISFKFGQKIFYVNYLSELSEHVKLEQLGIPRQVLKYDDFLKSTQKSPARSGGHAGGPLEKRGARLQHLQEKNPEQEPIPIVLRETVAYLQAHALTTEGIFRRSANTQVVREVQQKYNMGLPVDFDQYNELHLPAVILKTFLRELPEPLLTFDLYPHVVGFLNIDESQRVPATLQVLQTLPEENYQVLRFLTAFLVQISAHSDQNKMTNTNLAVVFGPNLLWAKDAAITLKAINPINTFTKFLLDHQGELFPSPDPSGL

SEQ ID NO: 1029632 - protein, 353 aa, Homo sapiens
GCNELRSHSSLGEGDSVSKKKSMHWDPSVAPVPPRLLLSCPFCLCKYKKNIKALYIVHPTMFIKTLLILFKPLISFKFGQKIFYVNYLSELSEHVKLEQLGIPRQVLKYDDFLKSTQKSPATAPKPMPPRPPLPNQQFGVSLQHLQEKNPEQEPIPIVLRETVAYLQAHALTTEGIFRRSANTQVVREVQQKYNMGLPVDSGCAELLSAAPTPGLPVDFDQYNELHLPAVILKTFLRELPEPLLTFDLYPHVVGFLNIDESQRVPATLQVLQTLPEENYQVLRFLTAFLVQISAHSDQNKMTNTNLAVVFGPNLLWAKDAAITLKAINPINTFTKFLLDHQGELFPSPDPSGL

SEQ ID NO: 1029633 - protein, 439 aa, Homo sapiens; identical to SEQ ID NO: 1029630

SEQ ID NO: 1029634 - protein, 439 aa, Homo sapiens; identical to SEQ ID NO: 1029630

SEQ ID NO: 1029635 - protein, 115 aa, Homo sapiens
MIPEPVLWGSSLTSPAPSASQAGPGHNFAGLSQDHQQCIQPPGAWAAAGSSSVPWSLASARAALLSALLCVSSVAHSPIHWGAFRIYLVFLMSPTGLYPRERVLVLCESSVHIHT

SEQ ID NO: 1029636 - protein, 439 aa, Homo sapiens; identical to SEQ ID NO: 1029630

SEQ ID NO: 1029637 - protein, 157 aa, Homo sapiens
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPRSSHQPRSIPQATVNPQATVNP

SEQ ID NO: 1029638 - protein, 439 aa, Homo sapiens; identical to SEQ ID NO: 1029630

SEQ ID NO: 1029639 - protein, 421 aa, Homo sapiens
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETMYHGVPVVGIPLFGDHYDTMTRVQAKGMGILLEWKTVTEKELYEALVKVINNPR

SEQ ID NO: 1029640 - protein, 541 aa, Homo sapiens
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETMYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 1029641 - protein, 541 aa, Homo sapiens
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLPAIELFDILDHYTKNCDMMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFVSHGGLNSIFETMYHGVPVVGIPVFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 1029642 - protein, 541 aa, Homo sapiens; identical to SEQ ID NO: 1029641

SEQ ID NO: 1029643 - protein, 146 aa, Homo sapiens
GQSRAQRMSLRALPFQLGRCRMAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKNLQTVNVDEN

SEQ ID NO: 1029644 - protein, 142 aa, Homo sapiens
PKIRPLWSGPFQLGRCRMAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKNLQTVNVDEN

SEQ ID NO: 1029645 - protein, 353 aa, Homo sapiens
TRPRTSFLTSRWSVSLLCTPPLSRPACCSLAVALFRDAPVCSCVAVFIQCSADPLWEEGNVFFLHGMAPLWPALFFIPPPGSGVRQLPSHFNNRAAPVFLPTPVLFTRAHPWFHGSPPTMCRRTPPLFSFPVVFQLCNTTAPRAPDPIRAEDLELVFGYTILSRIHAVSPEKSLNQFGSDYPLDAEGKVTETRCYPHFCMVFNFKECKPMPSPSLDRFRLCVMAAPGRMAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKNLQTVNVDEN

SEQ ID NO: 1029646 - protein, 146 aa, Homo sapiens; identical to SEQ ID NO: 1029643

SEQ ID NO: 1029647 - protein, 125 aa, Homo sapiens [sequence omitted]

SEQ ID NO: 1029648 - protein, 146 aa, Homo sapiens; identical to SEQ ID NO: 1029643

SEQ ID NO: 1029649 - protein, 146 aa, Homo sapiens; identical to SEQ ID NO: 1029643

SEQ ID NO: 1029650 - protein, 133 aa, Homo sapiens
LNKLLSLCLYPFWLISIPIMAVHVTNILFQINETINIHKRIHGVGFKKRAPRALKEIRKFAMKEMGTPDVRIDTRLNKAVWAKGIRNVPYRIRVRLSRKRNEDEDSPNKLYTLVTYVPVTTFKNLQTVNVDEN

SEQ ID NO: 1029651 - protein, 125 aa, Homo sapiens [sequence omitted]

SEQ ID NO: 1029652 - protein, 146 aa, Homo sapiens; identical to SEQ ID NO: 1029643

SEQ ID NO: 1029653 - protein, 146 aa, Homo sapiens; identical to SEQ ID NO: 1029643

SEQ ID NO: 1029654 - protein, 142 aa, Homo sapiens; identical to SEQ ID NO: 1029644

SEQ ID NO: 1029655 - protein, 125 aa, Homo sapiens [sequence omitted]

SEQ ID NO: 1029656 - protein, 125 aa, Homo sapiens [sequence omitted]

SEQ ID NO: 1029657 - protein, 146 aa, Homo sapiens; identical to SEQ ID NO: 1029643

SEQ ID NO: 1029658 - protein, 146 aa, Homo sapiens; identical to SEQ ID NO: 1029643

SEQ ID NO: 1029659 - protein, 134 aa, Homo sapiens
GFPTGTLQMGSRKEGCREKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKNLQTVNVDEN

SEQ ID NO: 1029660 - protein, 170 aa, Homo sapiens
MAPAKKGGEKKKGRSAINEVVTREYTINIHKRIHGVGFKKRAPRALKEIRKFAMKEKKCCLFIHQYVTPKEQEGIQKNNLEELTEELTKVMVDYIGMENFWKRYNKVKLEQLSLQHRRAQLLDINGKLREMSEQYLDGISVSDEVLSQLNPLFIVNYQSNLLQRADKQGS

SEQ ID NO: 1029661 - protein, 152 aa, Homo sapiens
MDGPLKVESLFHRWEIEAPRANSARGRMAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKNLQTVNVDEN

SEQ ID NO: 1029662 - protein, 146 aa, Homo sapiens; identical to SEQ ID NO: 1029643

SEQ ID NO: 1029663 - protein, 110 aa, Homo sapiens
GFPTGTLQMGSRKEGCREKKKGRSAINEVVTREYTINIHKRIHGVGFKKRAPRALKEIRKFAMKEMGLQMSALQPGLTKLVWPRIRMSHPDPFRCPEPIGGVPISYTCTL

SEQ ID NO: 1029664 - protein, 146 aa, Homo sapiens; identical to SEQ ID NO: 1029643

SEQ ID NO: 1029665 - protein, 125 aa, Homo sapiens [sequence omitted]

SEQ ID NO: 1029666 - protein, 146 aa, Homo sapiens; identical to SEQ ID NO: 1029643

SEQ ID NO: 1029667 - protein, 150 aa, Homo sapiens [sequence omitted]

SEQ ID NO: 1029668 - protein, 180 aa, Homo sapiens
VGRAADSGDVNPAGIILLSTNIQEPAHDLRMYGKIIFVLLLSAIVSISALSTTEVAMHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 1029669 - protein, 167 aa, Homo sapiens
SVAHYLRRAQIMISGSCLDRELICVLLMSAIVSISALSTTEVAMHTSTSSSVTKSYISSQTNDTHKRDTYAATPRAHEVSEISVRTVYPPEEETGERVQLAHHFSEPEITLIIFGVMAGVIGTILLISYGIRRLIKKSPSDVKPLPSPDTDVPLSSVEIENPETSDQ

SEQ ID NO: 1029670 - protein, 123 aa, Homo sapiens [sequence omitted]

SEQ ID NO: 1029671 - protein, 150 aa, Homo sapiens [sequence omitted]

SEQ ID NO: 1029672 - protein, 117 aa, Homo sapiens; identical to SEQ ID NO: 760499

SEQ ID NO: 1029673 - protein, 90 aa, Homo sapiens
GGEVSPRPGQAPGRAVRPSSRVPSWAERTRRCPAPDQTSRGLGPGPRAASAPVEPLRVSGFGAGARGRGSSVHACSLRRRGSRPGHGFPE

SEQ ID NO: 1029674 - protein, 90 aa, Homo sapiens; identical to SEQ ID NO: 1029673

SEQ ID NO: 1029675 - protein, 935 aa, Homo sapiens
GAPPPASLPPCSLISECCASNQRDSVGIGPSEPGVGYSLVVCRFLSWSEKRNIRVGVTRIFQVQIEHDPELEKESPGLKTSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKPEERSSR

SEQ ID NO: 1029676 - protein, 742 aa, Homo sapiens
GAPPPASLPPCSLISECCASNQRDSVGIGPSEPGVGYSLVVCRFLSWSEKRNIRVGVTRIFQVQIEHDPELEKESPGLKTSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADSGI

SEQ ID NO: 1029677 - protein, 736 aa, Homo sapiens
SYPRDVYPLRVSDMLDRCSCRYNAQCMLSRRILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 1029678 - protein, 971 aa, Homo sapiens
GAPPPASLPPCSLISECCASNQRDSVGIGPSEPGVGYSLVVCRFLSWSEKRNIRVGVTRIFQVQIEHDPELEKESPGLKTSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTQINWTLNKFLVNSFLSPNHLELLSSASFCSFSFLCLAMNF

SEQ ID NO: 1029679 - protein, 525 aa, Homo sapiens
GAPPPASLPPCSLISECCASNQRDSVGIGPSEPGVGYSLVVCRFLSWSEKRNIRVGVTRIFQVQIEHDPELEKESPGLKTSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKELKLQPRELELGKLCHQKKLL

SEQ ID NO: 1029680 - protein, 446 aa, Homo sapiens
GAPPPASLPPCSLISECCASNQRDSVGIGPSEPGVGYSLVVCRFLSWSEKRNIRVGVTRIFQVQIEHDPELEKESPGLKTSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGRRIS

SEQ ID NO: 1029681 - protein, 953 aa, Homo sapiens
GAPPPASLPPCSLISECCASNQRDSVGIGPSEPGVGYSLVVCRFLSWSEKRNIRVGVTRIFQVQIEHDPELEKESPGLKTSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 1029682 - protein, 495 aa, Homo sapiens
GIASNKMLIILQVQIEHDPELEERKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 1029683 - protein, 505 aa, Homo sapiens
GAPPPASLPPCSLISECCASNQRDSVGIGPSEPGVGYSLVVCRFLSWSEKRNIRVGVTRIFQVQIEHDPELEKESPGLKTSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKVRRVGRMAQCVFEVISSAAVAM

SEQ ID NO: 1029684 - protein, 140 aa, Homo sapiens [sequence omitted]

SEQ ID NO: 1029685 - protein, 140 aa, Homo sapiens [sequence omitted]

SEQ ID NO: 1029686 - protein, 140 aa, Homo sapiens [sequence omitted]

SEQ ID NO: 1029687 - protein, 71 aa, Homo sapiens
GTVRPQGLDSEGGKYVSVSQLSPLLRRSAGTWDGKASAGDAGLHAAADCDPVQGRPPTLTVPSEAPLGHAM

SEQ ID NO: 1029688 - protein, 140 aa, Homo sapiens [sequence omitted]

SEQ ID NO: 1029689 - protein, 71 aa, Homo sapiens; identical to SEQ ID NO: 1029687

SEQ ID NO: 1029690 - protein, 151 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 1029691 - protein, 146 aa, Homo sapiens
GHYCRKRSRRAEQSRCVTSPKTRPQSSRRPSSCLTEQVMARSCTASVGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 1029692 - protein, 100 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEVFGRWDPLG

SEQ ID NO: 1029693 - protein, 494 aa, Homo sapiens
MCDFTEDQTAEFKEAFQLFDRTGGYNEVDEEEEEGGWRNEEARNEEGDGERKRMEMKTERNADSATGKRAADDDARMTDCPYQATKRPHEDRIDSEQQETVNTKKQTTQTHNKHTQTTTTNKTHPPPTPQPKPPTQHPPPPQQPTDDQTTKAQPDKRANTSTDQHAPRPQTNNATQRKPTDATSTATRNQNDRPNDHKHNDDAQTLTTDSKWRRNGHTTTTTNLNPTANRTPTHNPTHNPQRYPAHNARRHHTDARERPQPNARRNAQTDANATHRTAATNSSQTRTTRDAQPDQRTHKDATPDERQYRTPPPADTEAKRNGSTRTAVTQKATRDTPNAEWAAQQNRERSTHNHSNTACRGRNNTHNTHEWTKPTRETHQNATHNKRDRNRRTNNPRRTTATSTNNHNDGTSSTTEQPNARTNQAENSDDDSDTGRRKQTNPGEATHNAKRASDQQPDRTIPGETQNQDDSDDHDNPAASRKRPNVTRTKGQLT

SEQ ID NO: 1029694 - protein, 151 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 1029695 - protein, 151 aa, Homo sapiens; identical to SEQ ID NO: 1029694

SEQ ID NO: 1029696 - protein, 162 aa, Homo sapiens
GWGKLSAETKGYSWETECRPPGHYSFLQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 1029697 - protein, 163 aa, Homo sapiens
MCDFTEDQTAEFKEACILFQALEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 1029698 - protein, 112 aa, Homo sapiens
MSRTAEAQRCSQSFGTISSVAFRTVSYGTQVDDSGRVLLFGTAASLRLPQGEFSPGNTRSSSRLFSCTREETRCAREEDEIYKRRDEMLVAGHEDSNGCINYEELVRMVLNG

SEQ ID NO: 1029699 - protein, 151 aa, Homo sapiens; identical to SEQ ID NO: 1029690

SEQ ID NO: 1029700 - protein, 156 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFPCVNFVSSLKFP

SEQ ID NO: 1029701 - protein, 172 aa, Homo sapiens
YAPKTVYFPKSRTHKRGVFIKNQTAQLKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVKILWQNMKTTIFFKILKIPPNVLKGKDLPKPP

SEQ ID NO: 1029702 - protein, 82 aa, Homo sapiens
SINRTGKGTDSGETGKVINQTADGKILYSQCGDVMMVMGVVMMVMGVVLDSGDGSDDGDDEDDEVMGVMVMVVVVVMTVPVQ

SEQ ID NO: 1029703 - protein, 151 aa, Homo sapiens; identical to SEQ ID NO: 1029694

SEQ ID NO: 1029704 - protein, 151 aa, Homo sapiens; identical to SEQ ID NO: 1029690

SEQ ID NO: 1029705 - protein, 166 aa, Homo sapiens
YAPKTVYFPKSRTHKRGVFIKNQTAQLKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 1029706 - protein, 132 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNNSSVWSWAHSSSAKSFPLSSEAPNSSKSGLANPMDFLAFSGESSVISLFGLY

SEQ ID NO: 1029707 - protein, 121 aa, Homo sapiens
SSNSISQTIFNFTLCLTVDNKQHYRNSTSYSLNDYFILWPIVDSLEVTPVAHSKLVTELSSDTGSSKTRRPFVERTGEPPTHYWLKSKGAHTTMADALWRLRDLMLRDTLNIRQAYNLENV

SEQ ID NO: 1029708 - protein, 121 aa, Homo sapiens; identical to SEQ ID NO: 1029707

SEQ ID NO: 1029709 - protein, 121 aa, Homo sapiens; identical to SEQ ID NO: 1029707

SEQ ID NO: 1029710 - protein, 271 aa, Homo sapiens
SWRFEDAAFGLDEFQIRLAGFLIVICLYTYTSPPKCSGYNNVNMDMIFIYYPLSSFRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAIRQAWWCIHCFPSFWAGERLKETAEAGGERLPVSQDHTSASQDSLEEQDGGDTTTIKRARGNSEAFGKSQMDRGGLTGLAPGAQESEKTA

SEQ ID NO: 1029711 - protein, 117 aa, Homo sapiens
MVQRLTYRRRLSYNTASNKTRLSRTPGNRIVYLYTKKVGKAPKSACGVCPGKLRGVRPVRPKVLMRLSKTKKHVSRAYGGSMCAKCVRDRIKRAFLIEEQKIIVKVLKAQAQSQKAK

SEQ ID NO: 1029712 - protein, 129 aa, Homo sapiens
TRSQQRPLMMAAQKITHQSESVSCDGAGCRGASQCVPPHLGTCHTQARHRPDSQDGRSERNTRPVDILPPRLSPSPGLGSVPGPHWSCSRLCDQPGAWLQRGPGGVKIFHRRRPYLQLTPLSGALASHL

SEQ ID NO: 1029713 - protein, 129 aa, Homo sapiens; identical to SEQ ID NO: 1029712

SEQ ID NO: 1029714 - protein, 114 aa, Homo sapiens
MWKSVVGHDVSVSVETQGDDWDTDPDFVNDISEKEQRWGAKTIEGSGRTEHIKKVPKGLEKRKGVMGRAQRKLGDLGEDFKKCQWMTTLHKQHTVKAWHKFLHLDDNTTLFNQK

SEQ ID NO: 1029715 - protein, 406 aa, Homo sapiens
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKSAVGFDYKGEVEKHTSQKDYSRGFGGRYGVEKDKWDKAALGYDYKGETEKHESQRDYAKGFGGQYGIQKDRVDKSAVGFNEMEAPTTAYKKTTPIEAASSGARGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLGISAVALYDYQGEGSDELSFDPDDVITDIEMVDEGWWRGRCHGHFGLFPANYVKLLE

SEQ ID NO: 1029716 - protein, 399 aa, Homo sapiens
RNPYGWLKCSLYFFLFLLHFSLSVAFCFPCFPTSIFVFSIRSQIFPHLFPSLPIHASLYPLILTFPPTFVFHIPVFLPTDSSHHPFPAFVISYNSELSVLADYAKGFGGQYGIQKDRVDKSAVGFNEMEAPTTAYKKTTPIEAASSGARGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLEGLQVEEEPVYEAEPEPEPEPEPEPENDYEDVEEMDRHEQEDEPEGDYEEVLEPEDSSFSSALAGSSGCPAGAGAGAVALGISAVALYDYQGEGSDELSFDPDDVITDIEMVDEGWWRGRCHGHFGLFPANYVKLLE

SEQ ID NO: 1029717 - protein, 486 aa, Homo sapiens [sequence omitted]

SEQ ID NO: 1029718 - protein, 449 aa, Homo sapiens
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKSAVGFDYKGEVEKHTSQKDYAKGFGGQYGIQKDRVDKSAVGFNEMEAPTTAYKKTTPIEAASSGARGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLEGLQVEEEPVYEAEPEPEPEPEPEPENDYEDVEEMDRHEQEDEPEGDYEEVLEPEDSSFSSALAGSSGCPAGAGAGAVALGISAVALYDYQGEGSDELSFDPDDVITDIEMVDEGWWRGRCHGHFGLFPANYVKLLE

SEQ ID NO: 1029719 - protein, 276 aa, Homo sapiens
MGPPAVVVKIAYKKTTPIEAASSGARGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLEGLQVEEEPVYEAEPEPEPEPEPEPENDYEDVEEMDRHEQEDEPEGDYEEVLEPEDSSFSSALAGSSGCPAGAGAGAVALGISAVALYDYQGEGSDELSFDPDDVITDIEMVDEGWWRGRCHGHFGLFPANYVKLLE

SEQ ID NO: 1029720 - protein, 154 aa, Homo sapiens
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKVSDHSLSQPPTSSPVKIAHNH

SEQ ID NO: 1029721 - protein, 486 aa, Homo sapiens [sequence omitted]

SEQ ID NO: 1029722 - protein, 517 aa, Homo sapiens
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKSAVGFDYKGEVEKHTSQKDYSRGFGGRYGVEKDKWDKAALGYDYKGETEKHESQRDYAKGFGGQYGIQKDRVDKSAVGFNEMEAPTTAYKKTTPIEAASSGARGLKAKFESMAEEKRKREEEEKAQQVARRQQERKAVTKRSPEAPQPVIAMEEPAVPAPLPKKISSEAWPPVGTPPSSESEPVRTSREHPVPLLPIRQTLPEDNEEPPALPPRTLEGLQVEEEPVYEAEPEPEPEPEPEPENDYEDVEEMDRHEQEDEPEGDYEEVLEPEDSSFSSALAGSSGCPAGAGAGAVALGISAVALYDYQGEGSDELSFDPDDVITDIEMVDEGWWRGRCHGHFGLFPANYVKLLGFPVCLPGKVRLDCVVCLIVLFAHFPSLKKYL

SEQ ID NO: 1029723 - protein, 986 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 1029724 - protein, 730 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 1029725 - protein, 717 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSGGELFGLLGHPPRRP

SEQ ID NO: 1029726 - protein, 1337 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSVLEGAGDRHSHLSGLELLLCPHALVDTVPAPPSALHGDTHAHTHTHVHTHCPIAQETCRGPPLGASRLSPQGPGHLTLAPQEGSYLDFWDTHRGDPEAKKEKKEPEDLQSDPCHLPGHLGTVGKEASSAAPSGTPPPAQIPSAEKKPDPPVRPARPPGPLVTQEPHLGRNGMGASVPTNPPPPLCHSGPPPSGRTELVLSSPHCARPRTGDPSPCPTPSHFDGVCDISCCEVKEGPLRPAPFSCSLLVHVSIFPLVHLSSKQVMVTHAGPLGPPSSSPHSWALLSWSCWMQCPFGPPCRLASHSRPPGLAQLCQLLLCPGGRKSSQASTSPGASQPQPCTDPASALICSPADKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 1029727 - protein, 302 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGVLHSSLLLLSCGSRNGASFPCSLESSTHQALCWTGLFLRPSPFPRLPLAAPRTLRAGV

SEQ ID NO: 1029728 - protein, 1503 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEGCYDLQVGNPCCGTDTVSASPRMVPRCWGQHSEANGSSSLGRSCCAPELLPFLHLPGPPLPELLSLSPLFPLTPSWRTLACSFAEKIEMATLMTLSSPTPPYRPTPEDTQATLPPPVRPRGTRHRSLSLGESTGSPSSPYCIPAHISALPHGKGLPADDATFLVPAAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSVLEGAGDRHSHLSGLELLLCPHALVDTVPAPPSALHGDTHAHTHTHVHTHCPIAQETCRGPPLGASRLSPQGPGHLTLAPQEGSYLDFWDTHRGDPEAKKEKKEPEDLQSDPCHLPGHLGTVGKEASSAAPSGTPPPAQIPSAEKKPDPPVRPARPPGPLVTQEPHLGRNGMGASVPTNPPPPLCHSGPPPSGRTELVLSSPHCARPRTGDPSPCPTPSHFDGVCDISCCEVKEGPLRPAPFSCSLLVHVSIFPLVHLSSKQVMVTHAGPLGPPSSSPHSWALLSWSCWMQCPFGPPCRLASHSRPPGLAQLCQLLLCPGGRKSSQASTSPGASQPQPCTDPASALICSPADKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 1029729 - protein, 613 aa, Homo sapiens
SYDYLEVRDGHSESSTLIGRYCGYENLMHKSTSATLLKFVLTRTAILCSPIDLAARDRPPELAPPSRCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 1029730 - protein, 464 aa, Homo sapiens
MGASVPTNPPPPLCHSGPPPSGRTELVLSSPHCARPRTGDPSPCPTPSHFDGVCDISCCEVKEGPLRPAPFSCSLLVHVSIFPLVHLSSKQVMVTHAGPLGPPSSSPHSWALLSWSCWMQCPFGPPCRLASHSRPPGLAQLCQLLLCPGGRKSSQASTSPGASQPQPCTDPASALICSPADKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 1029731 - protein, 622 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEGCYDLQVGKPLLWDRHCFRLSTHGPEMLGTALRG

SEQ ID NO: 1029732 - protein, 139 aa, Homo sapiens
EKEGKGEGDGWSPRTSAEPRAEREAGDRKEGGEQREGEEVGERGRERSRSRSSKQAGERTPSPGLQCAASLAAAPPACPAWPACRCCSGCCCSRVPAGRWTWPTTPMTWRRRTTRSPSTTKTPARRLPFLGTLPWTKRT

SEQ ID NO: 1029733 - protein, 742 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGSGPPPELAPPSRCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 1029734 - protein, 818 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGFSTLHCSFSAVALEMVLPSHVPLSPPLTRPSAGQDSSSDPPHSPGSPWLLPGPSGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGPNTGQDDNLVWEPGVLASLVPDSCITHLLETSGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 1029735 - protein, 722 aa, Homo sapiens
VSYGWSALTRTAILCHLSTLRSGTPPELARPPGAAPTWVAAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 1029736 - protein, 304 aa, Homo sapiens
GQLDFPQTQNLMRKKRCRPAIQFISGTRDGRKEGGQEGRAFPTGGIGAWGPSLSPSVTRFPAAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 1029737 - protein, 615 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITTSVLARGPVLKF

SEQ ID NO: 1029738 - protein, 730 aa, Homo sapiens; identical to SEQ ID NO: 1029724

SEQ ID NO: 1029739 - protein, 622 aa, Homo sapiens; identical to SEQ ID NO: 1029731

SEQ ID NO: 1029740 - protein, 730 aa, Homo sapiens; identical to SEQ ID NO: 1029724

SEQ ID NO: 1029741 - protein, 127 aa, Homo sapiens
RQQNHTSTPPATHKQTRFRATQCSCCKIVQEHPTALLPPPQFLTHQAASHSSHHIQELRLKQVRLKVRCTNSTSNRPAMVHSSRRLHLSSLNSMVFSIQQAIVSRLDLNNLSSFRGMASNQLSDQFL

SEQ ID NO: 1029742 - protein, 130 aa, Homo sapiens; identical to SEQ ID NO: 753405

SEQ ID NO: 1029743 - protein, 112 aa, Homo sapiens; identical to SEQ ID NO: 816884

SEQ ID NO: 1029744 - protein, 66 aa, Homo sapiens
AAGYPVVDEWSEASPMTHLQLSQTQDPLYIWCHKVYCQDPYECEIRNPSECPAASDPVTLNLLRSY

SEQ ID NO: 1029745 - protein, 117 aa, Homo sapiens
TGVNVPEKFETNLRKPVYYRVCTQGRDSVTVAKKNGIKKGGHSKTRGPSLLDQQGYKGKLRAGKKVEKAGKTLSLFSYGFKKDRYIQCTVVVRAPLRRWMKYVRMLYCSPSAKSTGG

SEQ ID NO: 1029746 - protein, 133 aa, Homo sapiens
PRLSNPLRNLNGSFHDEQNLSVFMKLSKNWNNTCLPRSQFLIETGIRKTFSSRPTFQTARPTLAHVHHRFSQARHPTATADSRLLIPPPPGIYKFHLNPIGRTLAGNSSILLPTKARACHLPPLRDPDGKKEI

SEQ ID NO: 1029747 - protein, 805 aa, Homo sapiens
LCRTYSATYRTEFTMRTSHDARCQSLVLRSHTFHTYISNYFRSRTLRISADAIHAYAIHRHFTVAWPQIAHSVTSSAVIVRLKPLRCEASGMIFSEAYMKNMRRCNIRWCYFAIMALGLSGFSGTGIQMARKKFSGLEISLIFLFVIVTIIAIALIVVLATKTPAVDEISDSTSTPATTRVTTNPSDSGKCPNVLNDPVNVRINCIPEQFPTEGICAQRGCCWRPWNDSLIPWCFFVDNHGYNVQDMTTTSIGVEAKLNRIPSPTLFGNDINSVLFTTQNQTPNRFRFKITDPNKRRYEVPHQYVKEFTGPTVSDTLYDVKVAQNPFSIQVIRKSNGKTLFDTSIGPLVYSDQYLQISARLPSDYIYGIGEQVHKRFRHDLSWKTWPIFTRDQLPGDNNNNLYGHQTFFMCIEDTSGKSFGVFLMNSNAMEIFIQPTPIVTYRVTGGILDFYILLGDTPEQVVQQYQQLVGLPAMPAYWNLGFQLSRWNYKSLDVVKEVVRRNREAGIPFDTQVTDIDYMEDKKDFTYDQVAFNGLPQFVQDLHDHGQKYVIILDPAISIGRRANGTTYATYERGNTQHVWINESDGSTPIIGEVWPGLTVYPDFTNPNCIDWWANECSIFHQEVQYDGLWIDMNEVSSFIQGSTKGCNVNKLNYPPFTPDILDKLMYSKTICMDAVQNWGKQYDVHSLYGYSMAIATEQAVQKVFPNKRSFILTRSTFAGSGRHAAHWLGDNTASWEQMEWSITGMLEFSLFGIPLVGADICGFVAETTEELCRRWMQLGAFYPFSRNNSDGYEHQDPAFFGQN

SEQ ID NO: 1029748 - protein, 677 aa, Homo sapiens
MARKKFSGLEISLIFLFVIVTIIAIALIVVLATKTPAVDEISDSTSTPATTRVTTNPSDSGKCPNVLNDPVNVRINCIPEQFPTEGICAQRGCCWRPWNDSLIPWCFFVDNHGYNVQDMTTTSIGVEAKLNRIPSPTLFGNDINSVLFTTQNQTPNRFRFKITDPNKRRYEVPHQYVKEFTGPTVSDTLYDVKVAQNPFSIQVIRKSNGKTLFDTSIGPLVYSDQYLQISARLPSDYIYGIGEQVHKRFRHDLSWKTWPIFTRDQLPGDNNNNLYGHQTFFMCIEDTSGKSFGVFLMNSNAMEIFIQPTPIVTYRVTGGILDFYILLGDTPEQVVQQYQQLVGLPAMPAYWNLGFQLSRWNYKSLDVVKEVVRRNREAGIPFDTQVTDIDYMEDKKDFTYDQVAFNGLPQFVQDLHDHGQKYVIILDPAISIGRRANGTTYATYERGNTQHVWINESDGSTPIIGEVWPGLTVYPDFTNPNCIDWWANECSIFHQEVQYDGLWIDMNEVSSFIQGSTKGCNVNKLNYPPFTPDILDKLMYSKTICMDAVQNWGKQYDVHSLYGYSMAIATEQAVQKVFPNKRSFILTRSTFAGSGRHAAHWLGDNTASWEQMEWSITGMLEFSLFGIPLVGADICGFVAETTEELCRRWMQLGAFYPFSRNNSDGYEHQDPAFFGQN

SEQ ID NO: 1029749 - protein, 110 aa, Homo sapiens
MNVKRSKEVYRMERRTKYNIDVRLTDVVIKHKNSANKRQKSRRNDREPNVIYYRESKKKLDEITSEKGYGDNKLMRRKYEALNRITALTRGSIQAGGKTVNFCAKKEVTC

SEQ ID NO: 1029750 - protein, 669 aa, Homo sapiens
RDGIAPLSLCSKDQKGIALIVVLATKTPAVDEISDSTSTPATTRVTTNPSDSGKCPNVLNDPVNVRINCIPEQFPTEGICAQRGCCWRPWNDSLIPWCFFVDNHGYNVQDMTTTSIGVEAKLNRIPSPTLFGNDINSVLFTTQNQTPNRFRFKITDPNKRRYEVPHQYVKEFTGPTVSDTLYDVKVAQNPFSIQVIRKSNGKTLFDTSIGPLVYSDQYLQISARLPSDYIYGIGEQVHKRFRHDLSWKTWPIFTRDQLPGDNNNNLYGHQTFFMCIEDTSGKSFGVFLMNSNAMEIFIQPTPIVTYRVTGGILDFYILLGDTPEQVVQQYQQLVGLPAMPAYWNLGFQLSRWNYKSLDVVKEVVRRNREAGIPFDTQVTDIDYMEDKKDFTYDQVAFNGLPQFVQDLHDHGQKYVIILDPAISIGRRANGTTYATYERGNTQHVWINESDGSTPIIGEVWPGLTVYPDFTNPNCIDWWANECSIFHQEVQYDGLWIDMNEVSSFIQGSTKGCNVNKLNYPPFTPDILDKLMYSKTICMDAVQNWGKQYDVHSLYGYSMAIATEQAVQKVFPNKRSFILTRSTFAGSGRHAAHWLGDNTASWEQMEWSITGMLEFSLFGIPLVGADICGFVAETTEELCRRWMQLGAFYPFSRNNSDGYEHQDPAFFGQN

SEQ ID NO: 1029751 - protein, 799 aa, Homo sapiens
VVQLIYPSKSDTSSGALETKCRHESRRVQLYSCAICVNFPNWWLILENLTDSVLYQVDCTECLRSRFRRTCIRYQLTKVIDRYALTRMLHNTIGIKNRWISNNFVGKKGPRLFSSPENRDPTCQQNIFVDGRIYQNVRCVKMDIIGIALIVVLATKTPAVDEISDSTSTPATTRVTTNPSDSGKCPNVLNDPVNVRINCIPEQFPTEGICAQRGCCWRPWNDSLIPWCFFVDNHGYNVQDMTTTSIGVEAKLNRIPSPTLFGNDINSVLFTTQNQTPNRFRFKITDPNKRRYEVPHQYVKEFTGPTVSDTLYDVKVAQNPFSIQVIRKSNGKTLFDTSIGPLVYSDQYLQISARLPSDYIYGIGEQVHKRFRHDLSWKTWPIFTRDQLPGDNNNNLYGHQTFFMCIEDTSGKSFGVFLMNSNAMEIFIQPTPIVTYRVTGGILDFYILLGDTPEQVVQQYQQLVGLPAMPAYWNLGFQLSRWNYKSLDVVKEVVRRNREAGIPFDTQVTDIDYMEDKKDFTYDQVAFNGLPQFVQDLHDHGQKYVIILDPAISIGRRANGTTYATYERGNTQHVWINESDGSTPIIGEVWPGLTVYPDFTNPNCIDWWANECSIFHQEVQYDGLWIDMNEVSSFIQGSTKGCNVNKLNYPPFTPDILDKLMYSKTICMDAVQNWGKQYDVHSLYGYSMAIATEQAVQKVFPNKRSFILTRSTFAGSGRHAAHWLGDNTASWEQMEWSITGMLEFSLFGIPLVGADICGFVAETTEELCRRWMQLGAFYPFSRNNSDGYEHQDPAFFGQN

SEQ ID NO: 1029752 - protein, 1138 aa, Homo sapiens
EAQCCGLFHLSALGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 1029753 - protein, 1138 aa, Homo sapiens; identical to SEQ ID NO: 1029752

SEQ ID NO: 1029754 - protein, 1584 aa, Homo sapiens
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVMCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTLKRPSLPEEEKLKLAHAKGPPTNFNSLPANVSKLHLHGSPRYPGGPLPDFPNHSLTLKRDKAPKSSFVGDGDIFKKLDSELSRAQEKALDTSYVILPTATATLRPKPKEEPKYSIHIDQMPQTRLIHLSTAPEASLPARSPPSRQPPSGGPPEAPPAQPPPPPPPPPPPPQQPLPPPPNLEPAPPSLGDPGEPAAHPGPSTGPSTKNENVATLSVSSLERRKSRYAELDFEKIMHTRKRHQDMFQDLNRKLQHAAEKDKEVLGPDSKPEKQQTPNKRPWESLRKAHGTPTWVKKELEPLQPSPLELRSVEWERSGATIPLVGQDIIDLQTEV

SEQ ID NO: 1029755 - protein, 732 aa, Homo sapiens
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQVGSRGASWKRVSGRCLGSPPRP

SEQ ID NO: 1029756 - protein, 188 aa, Homo sapiens
TRGSTHASRTRGSGRVGAQQEALGEPPESPRDAHVGEEGAGAAAAVAAGASQRGVGEVGRHDPAGGPGHHRPPDRGLSGWAAATHWATEEGCCSARSCRRRAQTRSRAAGQARTPASGRSDGGQAQGPQCWDQSQMQDRRRPGQRAQGTRGRRCLRLRPPRAEAQRADGRTAVDRGQAQRGQRPRVPA

SEQ ID NO: 1029757 - protein, 105 aa, Homo sapiens
MAHPTALISLGSMILAPQPTEELGLQVCTNMPIRHPSGDVKNTVGYSKSSSRVEWLSDRKKRALQKKDVDVRRRIELIQDFEMPTVCTTIKVSKRWTVHFSNWNI

SEQ ID NO: 1029758 - protein, 125 aa, Homo sapiens
MQVSSLNEVKIYSLSCGKSLPEWLSDRKKRALQKKDVDVRRRIELIQDFEMPTVCTTIKVSKDGQYILATGTYKPRVRCYDTYQLSLKFERCVRFKKVGHPFATFESDELTQKIVFMTLHDKMTL

SEQ ID NO: 1029759 - protein, 163 aa, Homo sapiens
MQVSSLNEVKIYSLSCGKSLPEVSHFPAPSLSSSWGSSSSWGSLPLSSALASVLAGRWSPPDSGRPEAADNFRGRCRHWETRTLPSPRQKLDQGIIRVSELCWNFCKVLCSRERNHLGLFGCSQSLPYIEEENVADSLTHLSPIWPSAVCGVPIICQVLGIQQ

SEQ ID NO: 1029760 - protein, 218 aa, Homo sapiens
IRLGTRLGVNRPRRRPQSLSPVLSLSPDSMSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVI

SEQ ID NO: 1029761 - protein, 430 aa, Homo sapiens
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKHETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 1029762 - protein, 430 aa, Homo sapiens; identical to SEQ ID NO: 1029761

SEQ ID NO: 1029763 - protein, 430 aa, Homo sapiens; identical to SEQ ID NO: 1029761

SEQ ID NO: 1029764 - protein, 430 aa, Homo sapiens; identical to SEQ ID NO: 1029761

SEQ ID NO: 1029765 - protein, 430 aa, Homo sapiens; identical to SEQ ID NO: 1029761

SEQ ID NO: 1029766 - protein, 430 aa, Homo sapiens; identical to SEQ ID NO: 1029761

SEQ ID NO: 1029767 - protein, 218 aa, Homo sapiens; identical to SEQ ID NO: 1029760

SEQ ID NO: 1029768 - protein, 208 aa, Homo sapiens
GPPHLKSVSCPVGHPVSGGMSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVI

SEQ ID NO: 1029769 - protein, 218 aa, Homo sapiens; identical to SEQ ID NO: 1029760

SEQ ID NO: 1029770 - protein, 201 aa, Homo sapiens
MWLGTRLGVNRPKLSPVLSLSPDNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVI

SEQ ID NO: 1029771 - protein, 118 aa, Homo sapiens
MRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 1029772 - protein, 218 aa, Homo sapiens; identical to SEQ ID NO: 1029760

SEQ ID NO: 1029773 - protein, 218 aa, Homo sapiens
IWLGTRLGVNGRRPALGFDPWKVDAPKISGPRQDHGQTSGAQYDELARKEPRGARTSTGLSRLRRSTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 1029774 - protein, 189 aa, Homo sapiens
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVI

SEQ ID NO: 1029775 - protein, 218 aa, Homo sapiens; identical to SEQ ID NO: 1029760

SEQ ID NO: 1029776 - protein, 189 aa, Homo sapiens; identical to SEQ ID NO: 1029774

SEQ ID NO: 1029777 - protein, 218 aa, Homo sapiens; identical to SEQ ID NO: 1029760

SEQ ID NO: 1029778 - protein, 218 aa, Homo sapiens; identical to SEQ ID NO: 1029760

SEQ ID NO: 1029779 - protein, 218 aa, Homo sapiens; identical to SEQ ID NO: 1029760

SEQ ID NO: 1029780 - protein, 205 aa, Homo sapiens
MLVGLVLIGRGSLSGRMSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVI

SEQ ID NO: 1029781 - protein, 430 aa, Homo sapiens; identical to SEQ ID NO: 1029761

SEQ ID NO: 1029782 - protein, 430 aa, Homo sapiens; identical to SEQ ID NO: 1029761

SEQ ID NO: 1029783 - protein, 430 aa, Homo sapiens; identical to SEQ ID NO: 1029761

SEQ ID NO: 1029784 - protein, 430 aa, Homo sapiens; identical to SEQ ID NO: 1029761

SEQ ID NO: 1029785 - protein, 430 aa, Homo sapiens; identical to SEQ ID NO: 1029761

SEQ ID NO: 1029786 - protein, 189 aa, Homo sapiens; identical to SEQ ID NO: 1029774

SEQ ID NO: 1029787 - protein, 430 aa, Homo sapiens; identical to SEQ ID NO: 1029761

SEQ ID NO: 1029788 - protein, 218 aa, Homo sapiens; identical to SEQ ID NO: 1029760

SEQ ID NO: 1029789 - protein, 205 aa, Homo sapiens; identical to SEQ ID NO: 1029780

SEQ ID NO: 1029790 - protein, 189 aa, Homo sapiens; identical to SEQ ID NO: 1029774

SEQ ID NO: 1029791 - protein, 110 aa, Homo sapiens [sequence omitted]

SEQ ID NO: 1029792 - protein, 110 aa, Homo sapiens [sequence omitted]

SEQ ID NO: 1029793 - protein, 103 aa, Homo sapiens
MSGRLWSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029794 - protein, 137 aa, Homo sapiens
MFNPTRPRGGASSFSYRHLGSCGGLLGTGLLKGTMSGRLWSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029795 - protein, 103 aa, Homo sapiens; identical to SEQ ID NO: 1029793

SEQ ID NO: 1029796 - protein, 103 aa, Homo sapiens; identical to SEQ ID NO: 1029793

SEQ ID NO: 1029797 - protein, 132 aa, Homo sapiens
RPPTTTKFAAASTLGSCGGLLGTGLLKGTMSGRLWSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029798 - protein, 110 aa, Homo sapiens [sequence omitted]

SEQ ID NO: 1029799 - protein, 110 aa, Homo sapiens [sequence omitted]

SEQ ID NO: 1029800 - protein, 110 aa, Homo sapiens [sequence omitted]

SEQ ID NO: 1029801 - protein, 110 aa, Homo sapiens [sequence omitted]

SEQ ID NO: 1029802 - protein, 110 aa, Homo sapiens [sequence omitted]

SEQ ID NO: 1029803 - protein, 132 aa, Homo sapiens
NSRRRPRSFSYRHLGSCGGLLGTGLLKGTMSGRLWSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029804 - protein, 101 aa, Homo sapiens
FQTEFLLEVPFPAGLHRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029805 - protein, 124 aa, Homo sapiens
RAEFGTSSCGGLLGTGLLKGTMSGRLWSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029806 - protein, 124 aa, Homo sapiens; identical to SEQ ID NO: 1029805

SEQ ID NO: 1029807 - protein, 103 aa, Homo sapiens; identical to SEQ ID NO: 1029793

SEQ ID NO: 1029808 - protein, 125 aa, Homo sapiens
ARSEAGCGSCGGLLGTGLLKGTMSGRLWSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029809 - protein, 113 aa, Homo sapiens
AAAYYYYYYYIRGRSTSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029810 - protein, 103 aa, Homo sapiens; identical to SEQ ID NO: 1029793

SEQ ID NO: 1029811 - protein, 124 aa, Homo sapiens; identical to SEQ ID NO: 1029805

SEQ ID NO: 1029812 - protein, 182 aa, Homo sapiens
MHSDSVSNGLSRKIASEFGTNHATVSMGPSYFSPDDSGFVWFAARSDCVVLCFDIHKRISYRHLGSCGGLLGTGLLKGTMSGRLWSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029813 - protein, 132 aa, Homo sapiens; identical to SEQ ID NO: 1029797

SEQ ID NO: 1029814 - protein, 132 aa, Homo sapiens; identical to SEQ ID NO: 1029803

SEQ ID NO: 1029815 - protein, 133 aa, Homo sapiens
NSRRRPRSFSYRHLGSCGGLLGTGLLKGTMSGRLWSKAIFAGYKRGLRNQREHTALLKIEGVYARDETEFYLGKRCAYVYKAKNNTVTSWRQTKQNQSHLGKSNSGPWKQWAWFVPNSEAIFLLRPLDTESEW

SEQ ID NO: 1029816 - protein, 101 aa, Homo sapiens
HRIRVMLYPSGFKRGLRNQREHTALLKIEGVYARDETEFYLGKRCAYVYKAKNNTVTSWRQTKQNQSHLGKSNSGPWKQWAWFVPNSEAIFLLRPLDTESE

SEQ ID NO: 1029817 - protein, 110 aa, Homo sapiens [sequence omitted]

SEQ ID NO: 1029818 - protein, 110 aa, Homo sapiens [sequence omitted]

SEQ ID NO: 1029819 - protein, 110 aa, Homo sapiens [sequence omitted]

SEQ ID NO: 1029820 - protein, 110 aa, Homo sapiens [sequence omitted]

SEQ ID NO: 1029821 - protein, 110 aa, Homo sapiens [sequence omitted]

SEQ ID NO: 1029822 - protein, 110 aa, Homo sapiens [sequence omitted]

SEQ ID NO: 1029823 - protein, 110 aa, Homo sapiens [sequence omitted]

SEQ ID NO: 1029824 - protein, 110 aa, Homo sapiens [sequence omitted]

SEQ ID NO: 1029825 - protein, 110 aa, Homo sapiens [sequence omitted]

SEQ ID NO: 1029826 - protein, 103 aa, Homo sapiens; identical to SEQ ID NO: 1029793

SEQ ID NO: 1029827 - protein, 110 aa, Homo sapiens [sequence omitted]

SEQ ID NO: 1029828 - protein, 103 aa, Homo sapiens; identical to SEQ ID NO: 1029793

SEQ ID NO: 1029829 - protein, 103 aa, Homo sapiens; identical to SEQ ID NO: 1029793

SEQ ID NO: 1029830 - protein, 132 aa, Homo sapiens; identical to SEQ ID NO: 1029797

SEQ ID NO: 1029831 - protein, 110 aa, Homo sapiens [sequence omitted]

SEQ ID NO: 1029832 - protein, 103 aa, Homo sapiens; identical to SEQ ID NO: 1029793

SEQ ID NO: 1029833 - protein, 125 aa, Homo sapiens; identical to SEQ ID NO: 1029808

SEQ ID NO: 1029834 - protein, 103 aa, Homo sapiens; identical to SEQ ID NO: 1029793

SEQ ID NO: 1029835 - protein, 110 aa, Homo sapiens [sequence omitted]

SEQ ID NO: 1029836 - protein, 110 aa, Homo sapiens [sequence omitted]

SEQ ID NO: 1029837 - protein, 110 aa, Homo sapiens [sequence omitted]

SEQ ID NO: 1029838 - protein, 110 aa, Homo sapiens [sequence omitted]

SEQ ID NO: 1029839 - protein, 110 aa, Homo sapiens [sequence omitted]

SEQ ID NO: 1029840 - protein, 132 aa, Homo sapiens; identical to SEQ ID NO: 1029803

SEQ ID NO: 1029841 - protein, 103 aa, Homo sapiens; identical to SEQ ID NO: 1029793

SEQ ID NO: 1029842 - protein, 1292 aa, Homo sapiens
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLCSSLVSFCKCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 1029843 - protein, 1278 aa, Homo sapiens
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 1029844 - protein, 501 aa, Homo sapiens
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNRRDAEEWFHAKSAELNRRCLQHCHDSDHSTTIA

SEQ ID NO: 1029845 - protein, 187 aa, Homo sapiens
DTLLVFAFKMPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSFQVKISKGRTHRFLDIFFSTAVHCWHTCFILGKKPNENECSLNMIKGGSFEQSK

SEQ ID NO: 1029846 - protein, 135 aa, Homo sapiens
DTLLVFAFKMPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSAK

SEQ ID NO: 1029847 - protein, 134 aa, Homo sapiens
DTLLVFAFKMPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSV

SEQ ID NO: 1029848 - protein, 429 aa, Homo sapiens
QFEHYKINFDDSKNGFSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQELDFKPFTSTIHLLKLGSPPPHKEARQRRKELRKKQLAEQGELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEELELERKQALEQYEEVKKKLEMATNKTKSWKDKVAHHEGLIRLIEPGSKNPHLITNWGPAAFTEAELEEREKNWKEKKTTE

SEQ ID NO: 1029849 - protein, 429 aa, Homo sapiens; identical to SEQ ID NO: 1029848

SEQ ID NO: 1029850 - protein, 429 aa, Homo sapiens; identical to SEQ ID NO: 1029848

SEQ ID NO: 1029851 - protein, 429 aa, Homo sapiens; identical to SEQ ID NO: 1029848

SEQ ID NO: 1029852 - protein, 136 aa, Homo sapiens
MVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAAAAAPAAAATAATTAATTAATAAQ

SEQ ID NO: 1029853 - protein, 92 aa, Homo sapiens
LPALTARGLSGGSRASVAAMVLLESEQFLTELTRLFQKCRTSGSVYITLMKKRDKKNKTKKTKAAAAAAAAAPAAAATAATTAATTAATAAQ

SEQ ID NO: 1029854 - protein, 136 aa, Homo sapiens; identical to SEQ ID NO: 1029852

SEQ ID NO: 1029855 - protein, 143 aa, Homo sapiens
MVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAGRQAGSAGAAGRSRQSKQAGKQAGRQAGRQQ

SEQ ID NO: 1029856 - protein, 272 aa, Homo sapiens
RPSPSRPLPFSPQSPRPCSFWLSPPTSDQRLDHSKSSSPEHCSTWTPVCLEGGLNVTLTIRLLMHGKEVGSIIGKKGESVKKMREESGARINISEGNCPERIITLAGPTNAIFKAFAMIIDKLEEDISSSMTNSTAASRPPVTLRLGGSLLVSVALSSDQGRHAPIKDNYERVQGLRSTVAGRSCYPTQLTGPSPIAGIPHSPSSQLSLTQQHLRASMTRHLSPQSPPPKGREPIPPNTGPSTHQASHEIHHHARVASATRVQGTHASDHAQ

SEQ ID NO: 1029857 - protein, 133 aa, Homo sapiens
RPSPSRPLPFSPQSPRPCSFWLSPPTSDQRLDHSKSSSPEHCSTWTPVCLEGGLNVTLTIRLLMHGKEVGSIIGKKGESVKKMREESGARINISEGNCPERIITLAGPTNAIFKAFAMIIDKLEEGHKQLYDQ

SEQ ID NO: 1029858 - protein, 469 aa, Homo sapiens
AAERALRGRDPGALRPHDPAHRPLLRDPGPRRSESPPGPGGDASLLARLFEHPLYRVAVPPLTEEDVLFNVNSDTRLSPKAAENPDWPHAGAEGAEFLSPGEAAVDSYPNWLKFHIGINRYELYSRHNPAIEALLHDLSSQRITSVAMKSGGTQLKLIMTFQNYGQALFKPMKQTREQETPPDFFYFSDYERHNAEIAAFHLDRILDFRRVPPVAGRMVNMTKEIRDVTRDKKLWRTFFISPANNICFYGECSYYCSTEHALCGKPDQIEGSLAAFLPDLSLAKRKTWRNPWRRSYHKRKKAEWEVDPDYCEEVKQTPPYDSSHRILDVMDMTIFDFLMGNMDRHHYETFEKFGNETFIIHLDNGRGFGKYSHDELSILVPLQQCCRIRKSTYLRLQLLAKEEYKLSLLMAESLRGDQVAPVLYQPHLEALDRRLRVVLKAVRDCVERNGLHSVVDDDLDTEHRAASAR

SEQ ID NO: 1029859 - protein, 277 aa, Homo sapiens
AAERALRGRDPGALRPHDPAHRPLLRDPGPRRSESPPGPGGDASLLARLFEHPLYRVAVPPLTEEDVLFNVNSDTRLSPKAAENPDWPHAGAEGAEFLSPGEAAVDSYPNWLKFHIGINRYELYSRHNPAIEALLHDLSSQRITSVAMKSGGTQLKLIMTFQNYGQALFKPMKQTREQETPPDFFYFSDYERHNAEIAAFHLDRILDFRRVPPVAGRMVNMTKEIRDVTRDKKLWRTFFISPANMRGPAFIPGSLARGPAFISPGSLARGAHIHLAR

SEQ ID NO: 1029860 - protein, 207 aa, Homo sapiens
MALRRAPQNLAWAPRLTLAPRRWEVDPDYCEEVKQTPPYDSSHRILDVMDMTIFDFLMGNMDRHHYETFEKFGNETFIIHLDNGRGWSLSSPLHTQGRAGHLPATCSPPETLGTGGADPPVEGWECRKGPSQSQMQRAAPGPNQEGGPPREWDLRGTGMLQTKSRQSWCYLGNGGQERLLVGRAGPCRIDGPLPARGTWSQPAGDRR

SEQ ID NO: 1029861 - protein, 469 aa, Homo sapiens; identical to SEQ ID NO: 1029858

SEQ ID NO: 1029862 - protein, 639 aa, Homo sapiens
AAERALRGRDPGALRPHDPAHRPLLRDPGPRRSESPPGPGGDASLLARLFEHPLYRVAVPPLTEEDVLFNVNSDTRLSPKAAENPDWPHAGAEGAEFLSPGEAAVDSYPNWLKFHIGINRYELYSRHNPAIEALLHDLSSQRITSVAMKSGGTQLKLIMTFQNYGQALFKPMKQTREQETPPDFFYFSDYERHNAEIAAFHLDRILDFRRVPPVAGRMVNMTKEIRDVTRDKKLWRTFFISPANKVTSEALPEPRAHQRAEPTETPPRPPDQGCQVISEALPEPRAHQRAEPTVDTPSAFQTKDARSSRRPCWSPEHIGGLSPLQTPPRPPNHGCQVVSEALLEPRAHWRAEPTADTPSASRGLNDPARGVNQKRENPISQEQGATLLPVCALREANRDAISWCLEEAGSLLANNICFYGECSYYCSTEHALCGKPDQIEGSLAAFLPDLSLAKRKTWRNPWRRSYHKRKKAEWEVDPDYCEEVKQTPPYDSSHRILDVMDMTIFDFLMGNMDRHHYETFEKFGNETFIIHLDNGRGFGKYSHDELSILVPLQQCCRIRKSTYLRLQLLAKEEYKLSLLMAESLRGDQVAPVLYQPHLEALDRRLRVVLKAVRDCVERNGLHSVVDDDLDTEHRAASAR

SEQ ID NO: 1029863 - protein, 252 aa, Homo sapiens
MVNMTKEIRDVTRDKKLWRTFFISPANNICFYGECSYYCSTEHALCGKPDQIEGSLAAFLPDLSLAKRKTWRNPWRRSYHKRKKAEWEVDPDYCEEVKQTPPYDSSHRILDVMDMTIFDFLMGNMDRHHYETFEKFGNETFIIHLDNGRGFGKYSHDELSILVPLQQCCRIRKSTYLRLQLLAKEEYKLSLLMAESLRGDQVAPVLYQPHLEALDRRLRVVLKAVRDCVERNGLHSVVDDDLDTEHRAASAR

SEQ ID NO: 1029864 - protein, 469 aa, Homo sapiens; identical to SEQ ID NO: 1029858

SEQ ID NO: 1029865 - protein, 194 aa, Homo sapiens
DSRLAAALSGGALVLSGLVHARGCTYSQLWSRSHPFCCSRGPLAMAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 1029866 - protein, 114 aa, Homo sapiens
MDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 1029867 - protein, 123 aa, Homo sapiens
MDLILDVNIQIYPVDLGDKFRLVIASTLYEDGTLDDGEYNPTDDRPSRADQFEYVMYGKVYRIEGDETSTEAATRLSAYVSYGGLLMSLQQDTDNMQAMEMDSIPCVLKLQMRSHTFSLISRP

SEQ ID NO: 1029868 - protein, 56 aa, Homo sapiens
MTVDVTGSGQHFCSSFSVTSSTQTPHQVAEVEEAEDVAVSPDFTAVQRKESEQSKP

SEQ ID NO: 1029869 - protein, 160 aa, Homo sapiens
SSVINAEWPLRRGFVWRKVGFVLTLCTKAGNGHQSCCEGKSQCINSIQEDSPRWICSNLISRSGRKRHDKEFSVLLVCTEQQTQRQKKRAPTDGGSLCPPGRSAVARPQPSAASASVLKGRARLSLPTCWDYGREPPPGNNLIKKKKARKKTKENKNTTP

SEQ ID NO: 1029870 - protein, 131 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDEFK

SEQ ID NO: 1029871 - protein, 318 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFLQHV

SEQ ID NO: 1029872 - protein, 318 aa, Homo sapiens; identical to SEQ ID NO: 1029871

SEQ ID NO: 1029873 - protein, 318 aa, Homo sapiens; identical to SEQ ID NO: 1029871

SEQ ID NO: 1029874 - protein, 318 aa, Homo sapiens; identical to SEQ ID NO: 1029871

SEQ ID NO: 1029875 - protein, 247 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGNEQACKIKSFYLKWDFF

SEQ ID NO: 1029876 - protein, 235 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGAGNGIHINRDLEMLQPTQMGRITVAYQVNIGLEMIKLASLPGWDPQNF

SEQ ID NO: 1029877 - protein, 247 aa, Homo sapiens; identical to SEQ ID NO: 1029875

SEQ ID NO: 1029878 - protein, 318 aa, Homo sapiens; identical to SEQ ID NO: 1029871

SEQ ID NO: 1029879 - protein, 318 aa, Homo sapiens; identical to SEQ ID NO: 1029871

SEQ ID NO: 1029880 - protein, 318 aa, Homo sapiens; identical to SEQ ID NO: 1029871

SEQ ID NO: 1029881 - protein, 341 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQIQCSKEDGGGWWYNRCHAANPNGRYYWGGQYTWDMAKHGTDDGVVWMNWKGSWYSMRGHGTQ

SEQ ID NO: 1029882 - protein, 318 aa, Homo sapiens; identical to SEQ ID NO: 1029871

SEQ ID NO: 1029883 - protein, 318 aa, Homo sapiens; identical to SEQ ID NO: 1029871

SEQ ID NO: 1029884 - protein, 318 aa, Homo sapiens; identical to SEQ ID NO: 1029871

SEQ ID NO: 1029885 - protein, 218 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGDDSDQNVKTSVTCRNGSLTGFECTPVEDTLQ

SEQ ID NO: 1029886 - protein, 318 aa, Homo sapiens; identical to SEQ ID NO: 1029871

SEQ ID NO: 1029887 - protein, 318 aa, Homo sapiens; identical to SEQ ID NO: 1029871

SEQ ID NO: 1029888 - protein, 318 aa, Homo sapiens; identical to SEQ ID NO: 1029871

SEQ ID NO: 1029889 - protein, 318 aa, Homo sapiens; identical to SEQ ID NO: 1029871

SEQ ID NO: 1029890 - protein, 300 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDDWKGDKVKAHYGGFTVQNEANKYQISVNKYRGTAGNALMDGASQLMGENRTMTIHNGMFLQHV

SEQ ID NO: 1029891 - protein, 300 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFLQHV

SEQ ID NO: 1029892 - protein, 131 aa, Homo sapiens; identical to SEQ ID NO: 1029870

SEQ ID NO: 1029893 - protein, 318 aa, Homo sapiens; identical to SEQ ID NO: 1029871

SEQ ID NO: 1029894 - protein, 375 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGDNDGWVTSDPMKQCSKEDGGGWWYNRCHAANPNGRYYWGGQYTWDMAKHGTDDGVVWMNWKGSWYSMRGHGTQ

SEQ ID NO: 1029895 - protein, 318 aa, Homo sapiens; identical to SEQ ID NO: 1029871

SEQ ID NO: 1029896 - protein, 318 aa, Homo sapiens; identical to SEQ ID NO: 1029871

SEQ ID NO: 1029897 - protein, 318 aa, Homo sapiens; identical to SEQ ID NO: 1029871

SEQ ID NO: 1029898 - protein, 281 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDGQDTQSIFHSSATIIIAIPTRRQSI

SEQ ID NO: 1029899 - protein, 318 aa, Homo sapiens; identical to SEQ ID NO: 1029871

SEQ ID NO: 1029900 - protein, 227 aa, Homo sapiens
MLEAVFTLTQTWGCCVLQDVSCKRLCYNRKGQSEIVLMSLNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGISPYL

SEQ ID NO: 1029901 - protein, 178 aa, Homo sapiens
YTVLVEAGLNRPRVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1029902 - protein, 105 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTDYFTNT

SEQ ID NO: 1029903 - protein, 351 aa, Homo sapiens
LGYRDRIHVTAIHHCAKCEEFCGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1029904 - protein, 352 aa, Homo sapiens
RGRAGAGDSRAPPAHAGPRGRGGGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1029905 - protein, 424 aa, Homo sapiens
MELPMGGIILEHVNPCKLRSMKGSLMATISTLPELKAALVTRRPIRPNPLTPTFTFPMVSEQMWLSAPPVRQSAASSFASPAEPHRSDTMGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1029906 - protein, 424 aa, Homo sapiens; identical to SEQ ID NO: 1029905

SEQ ID NO: 1029907 - protein, 284 aa, Homo sapiens
LRLRYEAGVQAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1029908 - protein, 424 aa, Homo sapiens; identical to SEQ ID NO: 1029905

SEQ ID NO: 1029909 - protein, 424 aa, Homo sapiens; identical to SEQ ID NO: 1029905

SEQ ID NO: 1029910 - protein, 427 aa, Homo sapiens
MELPMGGIILEHVNPCKLRSMKGSLMATISTLPELKAALVTRRPIRPNPLTPTFTFPMVSEQMWLSAPPVRQSAASSFASPAEPHRSDTMGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNELATAPGGPALARVNRHTRKGN

SEQ ID NO: 1029911 - protein, 389 aa, Homo sapiens
MELPMGGIILEHVNPCKLRSMKGSLMATISTLPELKAALVTRRPIRPNPLTPTFTFPMVSEQMWLSAPPVRQSAASSFASPAEPHRSDTMGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSPQRPLCQAHFLV

SEQ ID NO: 1029912 - protein, 274 aa, Homo sapiens
MELPMGGIILEHVNPCKLRSMKGSLMATISTLPELKAALVTRRPIRPNPLTPTFTFPMVSEQMWLSAPPVRQSAASSFASPAEPHRSDTMGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVVGLMTTVHFITFTQ

SEQ ID NO: 1029913 - protein, 189 aa, Homo sapiens
YTVLGRGWVNRPRVEEVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1029914 - protein, 158 aa, Homo sapiens
HKKPNWKRHAQSNQGPLVPTARGGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1029915 - protein, 424 aa, Homo sapiens; identical to SEQ ID NO: 1029905

SEQ ID NO: 1029916 - protein, 424 aa, Homo sapiens; identical to SEQ ID NO: 1029905

SEQ ID NO: 1029917 - protein, 424 aa, Homo sapiens; identical to SEQ ID NO: 1029905

SEQ ID NO: 1029918 - protein, 424 aa, Homo sapiens; identical to SEQ ID NO: 1029905

SEQ ID NO: 1029919 - protein, 279 aa, Homo sapiens
MAPVEAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1029920 - protein, 424 aa, Homo sapiens; identical to SEQ ID NO: 1029905

SEQ ID NO: 1029921 - protein, 296 aa, Homo sapiens
MELPMGGIILEHVNPCKLRSMKGSLMATISTLPELKAALVTRRPIRPNPLTPTFTFPMVSEQMWLSAPPVRQSAASSFASPAEPHRSDTMGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITAAGLSRTSSLPLLALPRLWARSSLS

SEQ ID NO: 1029922 - protein, 260 aa, Homo sapiens
MELPMGGIILEHVNPCKLRSMKGSLMATISTLPELKAALVTRRPIRPNPLTPTFTFPMVSEQMWLSAPPVRQSAASSFASPAEPHRSDTMGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNAFFTTNYLSPLTNVIHDNFYIL

SEQ ID NO: 1029923 - protein, 199 aa, Homo sapiens
MLFRYQGYIGAALVLGGVDVTGPHLYSIYPHGSTDKLPYVTMGSGSLAAMAVFEDKFRPDMEEEEAKNLVSEAIAAGIFNDLGSGSNIDLCVISKNKLDFLRHTQCPTRRGPGLAGTGVRKGLLQSSLEKITPLEIEVAGKKQSKHMDTFLNGHQLALAGPAVSGTVVSIEAQLRHSLLGSVCRMKLNSIKNKNQIGQV

SEQ ID NO: 1029924 - protein, 158 aa, Homo sapiens
MGSGSLAAMAVFEDKFRPDMEEEEAKNLVSEAIAAGIFNDLGSGSNIDLCVISKNKLDFLRHTQCPTRRGPGLAGTGVRKGLLQSSLEKITPLEIEVAGKKHVQTMDTFLNEHQLALAGPAVSGTVVSIEAQLKHSLLASVCRMKLNSIKNKNQIGQV

SEQ ID NO: 1029925 - protein, 162 aa, Homo sapiens
MLFRYRSGSLAAMAVFEDKFRPDMEEEEAKNLVSEAIAAGIFNDLGSGSNIDLCVISKNKLDFLRHTQCPTRRGPGLAGTGVRKGLLQSSLEKITPLEIEVAGKKQSKQSDTFLNGHQLALAGPAVSGTVVSIEAQLRHSLWVSVCRMKLNSIKNKNQIGQV

SEQ ID NO: 1029926 - protein, 70 aa, Homo sapiens
NCFLGKMAAVSVYAPPVGGFSFDNCRRNAVLEADFAKRGYKLPKVRKTGTTIAGVVYKDGIVLGADTKSN

SEQ ID NO: 1029927 - protein, 199 aa, Homo sapiens; identical to SEQ ID NO: 1029923

SEQ ID NO: 1029928 - protein, 199 aa, Homo sapiens; identical to SEQ ID NO: 1029923

SEQ ID NO: 1029929 - protein, 355 aa, Homo sapiens
MEGLGSSAWKIARLLGSAPGLRFFLSKRAHHTLAIHYPAWLMHQSGKFDFFAEKGEEERGLEEEGDQPGLPKAWPACRLSVAPMGQGRRPAVEGLGPIPGGLGGGGGGDRRAGVGTARPPCPTAVSFSICSPPKPPLFSMPQAPSVSPESPGELWLPGWTVAWPGPSLGLLACLSCCPSSKLLAPRLQERFQIVLPSLAPSRIHAHIHSFSKRPWSLFLHQSAGSNLVSVGQMAAVGCEQVSQPLRAGFFLCNTGVIIVPAFWAYRRIKGQNVDKVCRVTPARNTGPVSVAGECVTAGHARSRGGRQRRSPWASLEAHEAVLNMLKEEVPVPWEGPRNEEPWKETRGPGEQAEGR

SEQ ID NO: 1029930 - protein, 355 aa, Homo sapiens; identical to SEQ ID NO: 1029929

SEQ ID NO: 1029931 - protein, 361 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEGWVRAVEGRHRPCASATGPWAGCW

SEQ ID NO: 1029932 - protein, 517 aa, Homo sapiens
HEAPRHIYYNTQGAYVVRKEEISRVRWLTPVIPALWKAEAGRSRRQEIETILANTVKTLSLLKITKISWMWCCTPVIPPTWEAEIMEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFQNDSFLCYWFGDWWSMNL

SEQ ID NO: 1029933 - protein, 149 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQ

SEQ ID NO: 1029934 - protein, 227 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSMFGPDKCGEDYKLHFIFRHKNPKTGIYEEKHAKRPDADLKTYFTDKKTHLYTLSKKKH

SEQ ID NO: 1029935 - protein, 226 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLVCNSHFWNVAGHPLLPCKNFVIGPGVVAHACNPSSQHFGKPRQADHASGM

SEQ ID NO: 1029936 - protein, 167 aa, Homo sapiens
MTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFQNDSFLCYWFGDWWSMNL

SEQ ID NO: 1029937 - protein, 183 aa, Homo sapiens
MEGKWLLCMLLVLGTAIVEAHDGHDDDVIDIEDDLDDVIEEVEDSKPDTTAPPSSPKVTYKAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFCATGSETGGP

SEQ ID NO: 1029938 - protein, 429 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFCATGSETGGP

SEQ ID NO: 1029939 - protein, 473 aa, Homo sapiens
RRGFVRWGSLARQRWPRPLGSAARDGRAASASLFTAARGKIMEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFQNDSFLCYWFGDWWSMNL

SEQ ID NO: 1029940 - protein, 414 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFQNDSFLCYWFGDWWSMNL

SEQ ID NO: 1029941 - protein, 149 aa, Homo sapiens; identical to SEQ ID NO: 1029933

SEQ ID NO: 1029942 - protein, 95 aa, Homo sapiens
MEGKWLLCMLLVLGTAIVEAHDGHDDDVIDIEDDLDDVIEEVEDSKPDTTAPPSSPKVTYKAPVPTGEVYFVSNHCSSFISQGYLQSSSSNRGSI

SEQ ID NO: 1029943 - protein, 421 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFQNDSFLCYWFGDWWSMNL

SEQ ID NO: 1029944 - protein, 66 aa, Homo sapiens
MGKGDPKKPRGKMSSYAFFVQTCREEHKKKHPDASVNSKVLKSLKRVEPMSQRKKFEIATGSPYEN

SEQ ID NO: 1029945 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 1029946 - protein, 215 aa, Homo sapiens; identical to SEQ ID NO: 1029945

SEQ ID NO: 1029947 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVQAEKSPKKKEEEEDEEDEEDEEEEEDEEDEDEEEDDDDE

SEQ ID NO: 1029948 - protein, 215 aa, Homo sapiens; identical to SEQ ID NO: 1029945

SEQ ID NO: 1029949 - protein, 282 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEKKKKKKKFLGGKDPKKRCVRATPMWDSRGPSRVKRTRGAQRGSQEETAGQEKGGELTTQKKKGRGEHRVLEQPQEESGETKRDTTERPKRAKK

SEQ ID NO: 1029950 - protein, 205 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDVPSLKCFGGVTT

SEQ ID NO: 1029951 - protein, 246 aa, Homo sapiens
MYCAKHSPNNIVVSDFFLFVPLALDDSMCPFNDQDTEVLERCSMRPQVRAMYPAGASGKGQGIVCGDSGGSGGSGQPDLVTLLAHQTILHLPPPMDPLPLCLPVLLMLQWITQHPSLGPMPLKMDLPPGDPGVLPLSCPQECPDPHSYPGPRSPTPGLPSSAVNDDLLLLPSSLPSVTKGLPRCQLWNEGCPWEVMTLRYTGAQQIASSYPQTVFACMQPLALPLCGRKPAQGHTAGQQQHSWSQI

SEQ ID NO: 1029952 - protein, 227 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKKKKKKKKKKKKNPGGYFWGGAEQRGVHDKGGHAAHKRVSRGPGAFWCHQGGKHRGGPTQKGDTKKIGQRPRGNRA

SEQ ID NO: 1029953 - protein, 215 aa, Homo sapiens; identical to SEQ ID NO: 1029945

SEQ ID NO: 1029954 - protein, 218 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEGGIYEECMKKDEEEGGRCEEDEDEEEDDDDE

SEQ ID NO: 1029955 - protein, 215 aa, Homo sapiens; identical to SEQ ID NO: 1029945

SEQ ID NO: 1029956 - protein, 215 aa, Homo sapiens; identical to SEQ ID NO: 1029945

SEQ ID NO: 1029957 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKSKNERNEEERLTDTTERRTDGRTDGPTDTND

SEQ ID NO: 1029958 - protein, 282 aa, Homo sapiens; identical to SEQ ID NO: 1029949

SEQ ID NO: 1029959 - protein, 200 aa, Homo sapiens [sequence omitted]

SEQ ID NO: 1029960 - protein, 156 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYE

SEQ ID NO: 1029961 - protein, 167 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKLRKGKKCGFCLVN

SEQ ID NO: 1029962 - protein, 223 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKMKKMKMKKKMMMMNKLVLAQFFFFLSIKHLTPLYTTHSF

SEQ ID NO: 1029963 - protein, 186 aa, Homo sapiens
MVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAVWILNIYQVWELRGKAVGCGQAGGQQGWKPRGTPVGPEQWAPRPRPNTAGKQDNP

SEQ ID NO: 1029964 - protein, 220 aa, Homo sapiens [sequence omitted]

SEQ ID NO: 1029965 - protein, 220 aa, Homo sapiens [sequence omitted]

SEQ ID NO: 1029966 - protein, 172 aa, Homo sapiens
MVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKGAKPVTWKNPPG

SEQ ID NO: 1029967 - protein, 220 aa, Homo sapiens [sequence omitted]

SEQ ID NO: 1029968 - protein, 171 aa, Homo sapiens
MVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKGARPWPGKIPW

SEQ ID NO: 1029969 - protein, 220 aa, Homo sapiens [sequence omitted]

SEQ ID NO: 1029970 - protein, 333 aa, Homo sapiens
GRISRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPQNVVNVAGGFSLHQDPTRFKSIHCLLYPDTDWCPRQKQGAPTSR

SEQ ID NO: 1029971 - protein, 220 aa, Homo sapiens [sequence omitted]

SEQ ID NO: 1029972 - protein, 465 aa, Homo sapiens
GRISRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVSVGADAIGADAFLDTSPGGTAEGVESWLEKGIGLGAQADPPRWFACGVSGAGQEALTVLGREGVSGPGGEGLEATGQWPAEAPGSSCSKKLLLPGWDLLRGSFRKMPGESHEESGVRSPVLGSSDQHPILQVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPQNVVNVAGGFSLHQDPTRFKSIHCLLYPDTDWCPRQKQGAPTSR

SEQ ID NO: 1029973 - protein, 224 aa, Homo sapiens
MVARARRLIELYKEAGISKDRILINQLSVNLAKRAIQRWNEELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKAAQASDLEKIHLDEKSFRWLHNEDQMAVEKLSDGIRKFAADAVKLERMLTERMFNAENGK

SEQ ID NO: 1029974 - protein, 161 aa, Homo sapiens
MCGLGFNRAEVPFACAHLFWHVANTDKKSYEPLEDPGVKSVTKIYNYYKKFSYKTIVMGASFRNTGEIKALAGCDFLTISPKLLGELLQDNAKLVPVLSAKAAQASDLEKIHLDEKSFRWLHNEDQMAVEKLSDGIRKFAADAVKLERMLTERMFNAENGK

SEQ ID NO: 1029975 - protein, 103 aa, Homo sapiens
MSSSPVKRQRMESALDQLKQFTTVVADTGDFHAIDEYKPQDATTNPSLILAAAQMPAYQELVEEAIAYGRKLGGSQEDQIKNAIETSTTRPSFRSFISTADPH

SEQ ID NO: 1029976 - protein, 113 aa, Homo sapiens
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILREDSGPSIHRSRRKALL

SEQ ID NO: 1029977 - protein, 80 aa, Homo sapiens
SGGKLVIAVVYMVVRCKILVASVMSCNIWCDARGRSASARGNTHSGEAEYNTGWVGVLTNGPVIWGASKRFITNWSRDRS

SEQ ID NO: 1029978 - protein, 220 aa, Homo sapiens [sequence omitted]

SEQ ID NO: 1029979 - protein, 220 aa, Homo sapiens [sequence omitted]

SEQ ID NO: 1029980 - protein, 220 aa, Homo sapiens [sequence omitted]

SEQ ID NO: 1029981 - protein, 220 aa, Homo sapiens [sequence omitted]

SEQ ID NO: 1029982 - protein, 336 aa, Homo sapiens
MVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKAAGGPTAQLWLLLGQGSTAVPRCPVGDPSHLWAELILGDMKGEVDLNGGLGFPNTSHSSHQPRLCGLNPTSSVSFAGAKAGPGGRCLGAAVQALSPRGKGGQGHGSRHGRLVLVPQAAQASDLEKIHLDEKSFRWLHNEDQMAVEKLSDGIRKFAADAVKLERMLTERMFNAENGK

SEQ ID NO: 1029983 - protein, 186 aa, Homo sapiens; identical to SEQ ID NO: 1029963

SEQ ID NO: 1029984 - protein, 220 aa, Homo sapiens [sequence omitted]

SEQ ID NO: 1029985 - protein, 427 aa, Homo sapiens
GRISRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGECPPHPRRPRDLPPEPFSLRSHGPFLLWVPFSAQAPEARGGPDSCPGHAACGGPTLPAKLCSPPASHTSRFPGRGASATSPEEAPAGNPPFQASDRVINTNCSAVRTRQALCCKMSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPQNVVNVAGGFSLHQDPTRFKSIHCLLYPDTDWCPRQKQGAPTSR

SEQ ID NO: 1029986 - protein, 220 aa, Homo sapiens [sequence omitted]

SEQ ID NO: 1029987 - protein, 358 aa, Homo sapiens
GRISRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVTTVKFWFATGGAGFCLSRGLALKMSPWASEWGSSCPGWEAEAETCKVLTGLPPALGSFMSTAEQVRLPDDCTVGYIVEGLLGARLLHSPLFHSHLENLQRLPPDTLLQQVTLSHGGPENPQNVVNVAGGFSLHQDPTRFKSIHCLLYPDTDWCPRQKQGAPTSR

SEQ ID NO: 1029988 - protein, 106 aa, Homo sapiens [sequence omitted]

SEQ ID NO: 1029989 - protein, 333 aa, Homo sapiens; identical to SEQ ID NO: 1029970

SEQ ID NO: 1029990 - protein, 113 aa, Homo sapiens; identical to SEQ ID NO: 1029976

SEQ ID NO: 1029991 - protein, 115 aa, Homo sapiens
TSHIGYWSLGESDEAPVPSPPPPPQTPRSCYVELTREASEDGVRAGPAQAVHPSSWESCCRTTPSWCLCSQPRRPKPVTWKKSTWMRSLSVGCTTRTRWLWRSSLTGSASLPLMQ

SEQ ID NO: 1029992 - protein, 162 aa, Homo sapiens
MVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFAPKPGRGPPSGRGKPAGGGFPHFPSREAARPQGRAPGPRPNLVIRGRQGERA

SEQ ID NO: 1029993 - protein, 220 aa, Homo sapiens [sequence omitted]

SEQ ID NO: 1029994 - protein, 220 aa, Homo sapiens [sequence omitted]

SEQ ID NO: 1029995 - protein, 220 aa, Homo sapiens [sequence omitted]

SEQ ID NO: 1029996 - protein, 220 aa, Homo sapiens [sequence omitted]

SEQ ID NO: 1029997 - protein, 226 aa, Homo sapiens
GRISRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVSVGADAIGADAFLDTSHAAAQQRAWKAGLRRA

SEQ ID NO: 1029998 - protein, 199 aa, Homo sapiens
GRISRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVTWAAS

SEQ ID NO: 1029999 - protein, 206 aa, Homo sapiens
LGPAPALTRPRPQICPALTCPRPAELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDSSHLPKLLGELLQDNAKLVPVLSAKAAQASDLEKIHLDEKSFRWLHNEDQMAVEKLSDGIRKFAADAVKLERMLTERMFNAENGK

SEQ ID NO: 1030000 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 1030001 - protein, 141 aa, Homo sapiens
AQQKRDPASRKSPGEKWEWTGALTEVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 1030002 - protein, 273 aa, Homo sapiens
MNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 1030003 - protein, 1015 aa, Homo sapiens
AAPGSGGQLHRVPEGCRIMNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKANNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGPRFKNMASLCIPAQILDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRR

SEQ ID NO: 1030004 - protein, 1070 aa, Homo sapiens
AAPGSGGQLHRVPEGCRIMNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKANNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRR

SEQ ID NO: 1030005 - protein, 1071 aa, Homo sapiens
AAPGSGGQLHRVPEGCRIMNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKANNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQKRE

SEQ ID NO: 1030006 - protein, 939 aa, Homo sapiens
AAPGSGGQLHRVPEGCRIMNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKANNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGTCCRF

SEQ ID NO: 1030007 - protein, 1012 aa, Homo sapiens
AAPGSGGQLHRVPEGCRIMNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKANNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPPSASGTCTRTTTPTLAWVTR

SEQ ID NO: 1030008 - protein, 1105 aa, Homo sapiens
MSAKAISEQTGKELLYKFICTTSAIQNRFKYARVTPDTDWARLLQDHPWLLSQNLVVKPDQLIKRRGKLGLVGVDLTLDGVKSWLKPRLGQEATVGKATGFLKNFLIEPFAPHSQAEEFYVCIYATREGDYVLFHHEGGVDVGDVDAKAQKLLVGVDEKLNPEDIKKHLLVHAPDDKKEILASFISGLFNFYEDLYFTYLEINPLVVTKDGVYVLDLAAKVDATADYICKVKWGDIEFPPPFGRVAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMAWAPAIPNQPPTAAHTANFLLNAQRETSTPAPSRTASFYESMVDEVRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYPQAAVAYVSRSGGMSNELNNIISRTTDGVYEGVAIGGDRYPGSTFMDHVLRYQDTPGVKMIVVLGEIGGTEEYKISRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGALGLLWFQKRLPKYSCQFIEMCLMVTADHGPAVSGAHNTIICARTAVELVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 1030009 - protein, 619 aa, Homo sapiens
MASGAYNPYIEIIEQPRQRGMRFRYKCEGRSAGSIPGEHSTDNNRTYPSIQIMNYYGKGKVRITLVTKNDPYKPHPHDLVGKDCRDGYYEAEFGQERRPLFFQNLGIRCVKKKEVKEAIITRIKAGINPFNVPEKQLNDIEDCDLNVVRLCFQVFLPDEHGNLTTALPPVVSNPIYDNRAPNTAELRICRVNKNCGSVRGGDEIFLLCDKVQKDDIEVRFVLNDWEAKGIFSQADVHRQVAIVFKTPPYCKAITEPVTVKMQLRRPSDQEVSESMDFRYLPDEKDTYGNKAKKQKTTLLFQKLCQDHVETGFRHVDQDGLELLTSGDPPTLASQSAGITVNFPERPRPGLLGSIGEGRYFKKEPNLFSHDAVVREMPTGVSSQAESYYPSPGPISSGLSHHASMAPLPSSSWSSVAHPTPRSGNTNPLSSFSTRTLPSNSQGIPPFLRIPVGNDLNASNACIYNNADDIVGMEASSMPSADLYGISDPNMLSNCSVNMMTTSSDSMGETDNPRLLSMNLENPSCNSVLDPRDLRQLHQMSSSSMSAGANSNTTVFVSQSDAFEGSDFSCADNSMINESGPSNSTNPNSHGFVQDSQYSGIGSMQNEQLSDSFPYEFFQV

SEQ ID NO: 1030010 - protein, 638 aa, Homo sapiens
MLKSIINCYINLTDLLLFKNFSGAYNPYIEIIEQPRQRGMRFRYKCEGRSAGSIPGEHSTDNNRTYPSIQIMNYYGKGKVRITLVTKNDPYKPHPHDLVGKDCRDGYYEAEFGQERRPLFFQNLGIRCVKKKEVKEAIITRIKAGINPFNVPEKQLNDIEDCDLNVVRLCFQVFLPDEHGNLTTALPPVVSNPIYDNRAPNTAELRICRVNKNCGSVRGGDEIFLLCDKVQKDDIEVRFVLNDWEAKGIFSQADVHRQVAIVFKTPPYCKAITEPVTVKMQLRRPSDQEVSESMDFRYLPDEKDTYGNKAKKQKTTLLFQKLCQDHVETGFRHVDQDGLELLTSGDPPTLASQSAGITVNFPERPRPGLLGSIGEGRYFKKEPNLFSHDAVVREMPTGVSSQAESYYPSPGPISSGLSHHASMAPLPSSSWSSVAHPTPRSGNTNPLSSFSTRTLPSNSQGIPPFLRIPVGNDLNASNACIYNNADDIVGMEASSMPSADLYGISDPNMLSNCSVNMMTTSSDSMGETDNPRLLSMNLENPSCNSVLDPRDLRQLHQMSSSSMSAGANSNTTVFVSQSDAFEGSDFSCADNSMINESGPSNSTNPNSHGFVQDSQYSGIGSMQNEQLSDSFPYEFFQV

SEQ ID NO: 1030011 - protein, 545 aa, Homo sapiens
MLLRSKPALPPPLLMLLLLGPLGPLSPGALPRPAQAQQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATREDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 1030012 - protein, 543 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATREDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 1030013 - protein, 214 aa, Homo sapiens
SAAPRALLPGRSSPGLPGAWIPAISAPFKWVWVISWRGEQPGEPKMLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSSKK

SEQ ID NO: 1030014 - protein, 543 aa, Homo sapiens; identical to SEQ ID NO: 1030012

SEQ ID NO: 1030015 - protein, 326 aa, Homo sapiens
SAAPRALLPGRSSPGLPGAWIPAISAPFKWVWVISWRGEQPGEPKMLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKR

SEQ ID NO: 1030016 - protein, 96 aa, Homo sapiens
ASTQTTELTIPNFNWAGINSRGANINEIRQMSGAQIKMANPVEGSSGRQVTITGSAASISLAQYLINARLSSEKGMGAVEQCGSLKNPFVLSHPTV

SEQ ID NO: 1030017 - protein, 79 aa, Homo sapiens
ASTQTTELTIPNFNWAGINSRGANINEIRQMSGAQIKMANPVEGSSGRQVTITGSAASISLAQYLINARLSSEKGMGCS

SEQ ID NO: 1030018 - protein, 121 aa, Homo sapiens
QEVPSEAHGTRTPRMAAPGGSDVVMRPSPLFNPPLLCIPLCPFIQSLLLTLHLNICSTYPSVLSFCEFLQFNAAFLLAIQESFRTPPFFFIQPPSSFEPPLPPLCCCLQLSLPWVPCFPRH

SEQ ID NO: 1030019 - protein, 295 aa, Homo sapiens
GRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSRHPWRVHPGSFRPKCDENGNYLPLQCYGEHRLLLVCLPQRHGGPQTRSRGHHNCSESLELEDPSSGLGVTKQDLGPVPM

SEQ ID NO: 1030020 - protein, 51 aa, Homo sapiens
GRRSRSCREDQKPVMDDQRDLISNNEQLPMLGRDPDPPARLLKSVLERNLI

SEQ ID NO: 1030021 - protein, 230 aa, Homo sapiens
GRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 1030022 - protein, 229 aa, Homo sapiens
AALSLRCATEDPGVAMGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030023 - protein, 128 aa, Homo sapiens
ASTKAPRMPVWSLSAPAQDNILLRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030024 - protein, 229 aa, Homo sapiens; identical to SEQ ID NO: 1030022

SEQ ID NO: 1030025 - protein, 101 aa, Homo sapiens
KLRLGTRLGVGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030026 - protein, 236 aa, Homo sapiens
AALSLRCATEDPGVAMGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRRPQHEDCRRVSLLWKTPQGQLCDRAITVGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030027 - protein, 142 aa, Homo sapiens
AALSLRCATEDPGVAMGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADLKRLPQGIAEGGPLGPQG

SEQ ID NO: 1030028 - protein, 140 aa, Homo sapiens
AALSLRCATEDPGVAMGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADAQQDTRCFEARHFAGS

SEQ ID NO: 1030029 - protein, 61 aa, Homo sapiens
VSKFFLGPPQRPPSSKEGGLPPKWLDGIWKDMVKAGLIPDGCGVKYIPSRGPLDKWRALHS

SEQ ID NO: 1030030 - protein, 229 aa, Homo sapiens; identical to SEQ ID NO: 1030022

SEQ ID NO: 1030031 - protein, 229 aa, Homo sapiens; identical to SEQ ID NO: 1030022

SEQ ID NO: 1030032 - protein, 229 aa, Homo sapiens; identical to SEQ ID NO: 1030022

SEQ ID NO: 1030033 - protein, 112 aa, Homo sapiens
RGSPLEVLTGPKGIEVLRKPQDIVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030034 - protein, 131 aa, Homo sapiens
MGCSKGPWRQAFQVDVHVSDLALPQCRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030035 - protein, 131 aa, Homo sapiens; identical to SEQ ID NO: 1030034

SEQ ID NO: 1030036 - protein, 106 aa, Homo sapiens
MVQRGRPYLGYMSPMGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030037 - protein, 69 aa, Homo sapiens
QKRVWQDVMSWQAVSSGAEIHISKKWGFTKFNADEFEDMVAEKRLIPDGCGVKYIPSRGPLDKWRALHS

SEQ ID NO: 1030038 - protein, 106 aa, Homo sapiens
NVLTSARKKRMRMCIGYRLGDSSHGIHIGHIIMSIRTKLPQHRILLYMTHALAVYTFPGGQKIPISTKCGFTEIQMLTQLMKTFLLRIALCIPDSCALDYIPRRHY

SEQ ID NO: 1030039 - protein, 232 aa, Homo sapiens
MLVRPGISVCDRRLRVVCDVRDTSRCGGYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030040 - protein, 229 aa, Homo sapiens; identical to SEQ ID NO: 1030022

SEQ ID NO: 1030041 - protein, 113 aa, Homo sapiens
NELGPIIRKVTSLLSSGSKHGEGTEAGFIIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 1030042 - protein, 183 aa, Homo sapiens
MAAHSSFLGSVRSLLVVWVALRDLGDRPFRWMFMFLTLHYPNVGSKQACEVPLESPILGQHDGSRVHIGQVIMSIRTKLQNKEHVIEALRRAKFKFPGRQTGIVVRAARRVLRTIIASRLSVISVLYANGSVEIHISKKWGFTKFNADEFEDMVAEKRLIPDGCGVKYIPSRGPLDKWRALHS

SEQ ID NO: 1030043 - protein, 287 aa, Homo sapiens
SIAVPLKAPPAPSAGAAAAAADSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKDSGKRFTSRWLRVLMR

SEQ ID NO: 1030044 - protein, 265 aa, Homo sapiens
SIAVPLKAPPAPSAGAAAAAADSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGNMEIPVGWYGVVESAYEVINSRLHILGYWTLCSRFGREYNEES

SEQ ID NO: 1030045 - protein, 287 aa, Homo sapiens; identical to SEQ ID NO: 1030043

SEQ ID NO: 1030046 - protein, 240 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKDSGKRFTSRWLRVLMR

SEQ ID NO: 1030047 - protein, 227 aa, Homo sapiens
SIAVPLKAPPAPSAGAAAAAADSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKFSPIPLPNGGKAGSSPIKLSWVGPWGTWRFQCACMEWNECCWCLSEDSAPRFRD

SEQ ID NO: 1030048 - protein, 287 aa, Homo sapiens; identical to SEQ ID NO: 1030043

SEQ ID NO: 1030049 - protein, 572 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030050 - protein, 552 aa, Homo sapiens
GGPSQTQAAPKPEQAGPDPSFFASASGDPELEPQRDLPGPRRPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030051 - protein, 1112 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGERGRGRQAGGWREGRAGPGDGLRERRGPAASRWVPWGGFRSAPGEPGEDPIRVAGLGAGPGLFCSEGARGPPVGRKGFGGGQVQQKLLNWTEKVTRGRDRENPEEGPKSPRGPGYYNRCQRSVTVSWASAVAGCYQVAWAWGSPLERRLGTVTWSSQGPGGGAPLRSGLGAKGLSCPLLAHGALWPGSPLRPTAFAHFMGEGASGLWCLGQEWMGLCVLGWPRLAPSAAMREDVYSTRLQEPVRTPKMTGALCSAGACPGLTPDPLPLMEAFRQAPQSAPWLQDTSRSLLPEPRTPLPQCFPTLLPTRLLLTGGLAQLEPIVQQVLAEEPLAPHCPTPDQGDALEEGLDLSSSLSAPDHFQGLSPSWPALLRPKRSVWGASSWLQWDTGVPSKELGPDYFQPNTPGPVNCDLCAGMGFVVCPIPALLDLAKWVKAKAESELSFCLVPSPGLDATPGPVTHRAGSWEIPGRGQVLVSAGQPLLSAIPGEVAKVPTVSQAPHSLGLLQGLYAMEPWTWGYEGRWVLLSPGAWAPNLGPVPPGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030052 - protein, 697 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVVSIPSPGHLLWGGPWDEGQRRRPPRAILQALALPPPVTHFPPVLLKKQLWQRTLPGPPFPSSVPAFPRLPSAQCPGWPTASAQWVKRSNEVATEWGPWWPGGVAGVGGSAATGPHIRSCLCVPWKRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030053 - protein, 302 aa, Homo sapiens
RPSTVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030054 - protein, 344 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGARTRAGEGGVGSALLPPAGRGRK

SEQ ID NO: 1030055 - protein, 289 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFRAAPQFR

SEQ ID NO: 1030056 - protein, 282 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGERGRGRQAGGWREGRAGPGDGLRERRGPAASRWVPWGGFRSAPGEPGEDPIRVAGLGAGPGLFCSEGARGPPVGRKGFGGGQVQQKLLNWTEKVTRGRDRENPEEGPKSPRGPGYYNRCQRSVTVSWASAVAGCYQVAWAWGSLLRGVWEP

SEQ ID NO: 1030057 - protein, 552 aa, Homo sapiens; identical to SEQ ID NO: 1030050

SEQ ID NO: 1030058 - protein, 552 aa, Homo sapiens; identical to SEQ ID NO: 1030050

SEQ ID NO: 1030059 - protein, 619 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEGAHLGDGRGGGEAGGKEREERTVSRGGKPSGSWAPLPPLAADLPPTRALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030060 - protein, 550 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPFFMAC

SEQ ID NO: 1030061 - protein, 376 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNETW

SEQ ID NO: 1030062 - protein, 267 aa, Homo sapiens
AAALMNCESLLSPTPGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030063 - protein, 180 aa, Homo sapiens
MLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030064 - protein, 470 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVVSIPSPGHLLWGGPWDEGQRRRPPRAILQALALPPPVTHFPPVLLKKQLWQRTLPGPPFPSSVPAFPRLPSAQCPGWPTASAQWVKRSNEVATEWGPWWPGGVAGVGGSAATGPHIRSCLCVPWKRYVDGGISDNLPLYELKNTITVSPFSGESDICPQDSSTNIHELRVTNTSIQFNLRNLYRLSKALFPPEPLVLREMCKQGYRDGLRFLQRNGARTRAGEGGVGSALLPPAGRGRKL

SEQ ID NO: 1030065 - protein, 440 aa, Homo sapiens
GGPSQTQAAPKPEQAGPDPSFFASASGDPELEPQRDLPGPRLQRASGEQAAHRGLAAHGTRGPAAAAAMFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEGAHLFCMAERPAEAQWSSVLSQNFARGERRSRLELELQIREQDLRARLPPSSSVLGRDGPLLGYWR

SEQ ID NO: 1030066 - protein, 264 aa, Homo sapiens
DSRGSLSAFQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQPAGPAPLLSTPAPEARPVIGALGL

SEQ ID NO: 1030067 - protein, 282 aa, Homo sapiens; identical to SEQ ID NO: 1030056

SEQ ID NO: 1030068 - protein, 134 aa, Homo sapiens
RSNEIKCVQGGMAVDKKVTLNKQSLCSPGGLLEAAEGHLDCDMPRGPGLCVYPPLAGPLPGSQPVMSVWHAVGAQALIESFEDKTKLSLFHSPAQITRKFRLNSEGKLEQTVSMATTTQPMTQHLHVTYKKVTP

SEQ ID NO: 1030069 - protein, 252 aa, Homo sapiens
MSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 1030070 - protein, 252 aa, Homo sapiens; identical to SEQ ID NO: 1030069

SEQ ID NO: 1030071 - protein, 643 aa, Homo sapiens
MTRAGAGAGAGPLRGACASILPYGAGAAGRPTSRAVSPPRSLPRGGPRAGGRLGPGPGCAAGPRPAMVICCAAVNCSNRQGKGEKRAVSFHRFPLKDSKRLIQWLKAVQRDNWTPTKYSFLCSEHFTKDSFSKRLEDQHRLLKPTAVPSIFHLTEKKRGAGGHGRTRRKDASKATGGVRGHSSAATSRGAAGWSPSSSGNPMAKPESRRLKQAALQGEATPRAAQEAASQEQAQQALERTPGDGLATMVAGSQGKAEASATDAGDESATSSIEGGVTDKSGISMDDFTPPGSGACKFIGSLHSYSFSSKHTRERPSVPREPIDRKRLKKDVEPSCSGSSLGPDKGLAQSPPSSSLTATPQKPSQSPSAPPADVTPKPATEAVQSEHSDASPMSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 1030072 - protein, 371 aa, Homo sapiens
MTRAGAGAGAGPLRGACASILPYGAGAAGRPTSRAVSPPRSLPRGGPRAGGRLGPGPGCAAGPRPAMVICCAAVNCSNRQGKGEKRAVSFHRFPLKDSKRLIQWLKAVQRDNWTPTKYSFLCSEHFTKDSFSKRLEDQHRLLKPTAVPSIFHLTEKKRGAGGHGRTRRKDASKATGGVRGHSSAATSRGAAGWSPSSSGNPMAKPESRRLKQAALQGEATPRAAQEAASQEQAQQALERTPGDGLATMVAGSQGKAEASATDAGDESATSSIEGGVTDKSGISMDDFTPPGSGACKFIGSLHSYSFSSKHTRERPSVPREPIDRKRLKKDVEPSCSGSSLGPDKGLAGPGYCASTVRLLNRQSLRQKWVWP

SEQ ID NO: 1030073 - protein, 187 aa, Homo sapiens
SQLFAFPVRLWTHHFEFKCSIFLEPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 1030074 - protein, 433 aa, Homo sapiens
MQQSAVNSCSAVTHQRQRQQEQAQQALERTPGDGLATMVAGSQGKAEASATDAGDESATSSIEGGVTDKSGISMDDFTPPGSGACKFIGSLHSYSFSSKHTRERPSVPREPIDRKRLKKDVEPSCSGSSLGPDKGLAQSPPSSSLTATPQKPSQSPSAPPADVTPKPATEAVQSEHSDASPMSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 1030075 - protein, 580 aa, Homo sapiens
MTRAGAGAGAGPLRGACASILPYGAGAAGRPTSRAVSPPRSLPRGGPRAGGRLGPGPGCAAGPRPAMVICCAAVNCSNRQGKGEKRAVSFHRFPLKDSKRLIQWLKAVQRDNWTPTKYSFLCSEHFTKDSFSKRLEDQHRLLKPTAVPSIFHLTEKKRGAGGHGRTRRKDASKATGGVRGHSSAATSRGAAGWSPSSSGNPMAKPESRRLKQAALQGEATPRAAQEAASQEQAQQALERTPGDGLATMVAGSQGKAEASATDAGDESATSSIEGGVTDKSGISMDDFTPPGSGACKFIGSLHSYSFSSKHTRERPSVPREPIDRKRLKKDVEPSCSGSSLGPDKGLAQSPPSSSLTATPQKPSQSPSAPPADVTPKPATEAVQSEHSDASPMSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFKQNPRKGGEQQEGIKNAIRAKSKKRGPWQGPKKTNVGGKTHQG

SEQ ID NO: 1030076 - protein, 111 aa, Homo sapiens
GEDAGGWGGGGPAAGRLRLHLAVRRGRRGPAHVPSRVAAALPPSGRSAGGRAARAGAWLRGWAKARDGDLLCGRELLQPAGKGREARRLLPQVPPKGLKTSNPMVKSCSEG

SEQ ID NO: 1030077 - protein, 252 aa, Homo sapiens; identical to SEQ ID NO: 1030069

SEQ ID NO: 1030078 - protein, 252 aa, Homo sapiens; identical to SEQ ID NO: 1030069

SEQ ID NO: 1030079 - protein, 169 aa, Homo sapiens [sequence omitted]

SEQ ID NO: 1030080 - protein, 165 aa, Homo sapiens
MEPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 1030081 - protein, 165 aa, Homo sapiens; identical to SEQ ID NO: 1030080

SEQ ID NO: 1030082 - protein, 73 aa, Homo sapiens
KEPHVKQVSPALLPARSCLLFAAVCGVSLFLFREIRRKFRLNSEGKLEQTVSMATTTQPMTQHLHVTYKKVTP

SEQ ID NO: 1030083 - protein, 252 aa, Homo sapiens; identical to SEQ ID NO: 1030069

SEQ ID NO: 1030084 - protein, 333 aa, Homo sapiens
WIMYCTGKNPVDEVEFCLKQKTINSLEDIPDSSPGPRVGSQELTENLALDGDAQSPSAPPADVTPKPATEAVQSEHSDASPMSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 1030085 - protein, 404 aa, Homo sapiens
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 1030086 - protein, 404 aa, Homo sapiens; identical to SEQ ID NO: 1030085

SEQ ID NO: 1030087 - protein, 404 aa, Homo sapiens; identical to SEQ ID NO: 1030085

SEQ ID NO: 1030088 - protein, 404 aa, Homo sapiens; identical to SEQ ID NO: 1030085

SEQ ID NO: 1030089 - protein, 404 aa, Homo sapiens; identical to SEQ ID NO: 1030085

SEQ ID NO: 1030090 - protein, 404 aa, Homo sapiens; identical to SEQ ID NO: 1030085

SEQ ID NO: 1030091 - protein, 404 aa, Homo sapiens; identical to SEQ ID NO: 1030085

SEQ ID NO: 1030092 - protein, 163 aa, Homo sapiens
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPSARCLLPGSCYGTQRWADQDLGGADRAPAFESFRPPRCRERSELHTQWQFDFGLRVTG

SEQ ID NO: 1030093 - protein, 145 aa, Homo sapiens
GRVGRPTRRGRVGRLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 1030094 - protein, 194 aa, Homo sapiens
MLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 1030095 - protein, 404 aa, Homo sapiens; identical to SEQ ID NO: 1030085

SEQ ID NO: 1030096 - protein, 404 aa, Homo sapiens; identical to SEQ ID NO: 1030085

SEQ ID NO: 1030097 - protein, 404 aa, Homo sapiens; identical to SEQ ID NO: 1030085

SEQ ID NO: 1030098 - protein, 404 aa, Homo sapiens; identical to SEQ ID NO: 1030085

SEQ ID NO: 1030099 - protein, 404 aa, Homo sapiens; identical to SEQ ID NO: 1030085

SEQ ID NO: 1030100 - protein, 404 aa, Homo sapiens; identical to SEQ ID NO: 1030085

SEQ ID NO: 1030101 - protein, 404 aa, Homo sapiens; identical to SEQ ID NO: 1030085

SEQ ID NO: 1030102 - protein, 404 aa, Homo sapiens [sequence omitted]

SEQ ID NO: 1030103 - protein, 404 aa, Homo sapiens; identical to SEQ ID NO: 1030085

SEQ ID NO: 1030104 - protein, 213 aa, Homo sapiens [sequence omitted]

SEQ ID NO: 1030105 - protein, 404 aa, Homo sapiens; identical to SEQ ID NO: 1030085

SEQ ID NO: 1030106 - protein, 272 aa, Homo sapiens
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNKAEVTPPHPG

SEQ ID NO: 1030107 - protein, 404 aa, Homo sapiens; identical to SEQ ID NO: 1030085

SEQ ID NO: 1030108 - protein, 1356 aa, Homo sapiens
KAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTQTHTLSPSGSGKTFTTALISNATPLPVTYASSASTGHTTPLHVTDASSVSTGHATPLPVTDTSSASTGHATPLPVTSPSSASTGHATPLPVTDTSSVSTGDTTPLPVTDASSVASTGDTTPFMSPTLPQHPQVTPPLFLSPAFPQYPQVTPRLFLSLALPQHPQVTPPLFLSPTLPQYPQVTPPLFLSPTLPQHPQVTPPLFMSPTLPQHPQVTPPLFLSPTLPQHPQVTPPLFLSPTLPQHPQVTPPLFLSPTLPQHPQVTPPLFMSPTLPQYPQVTPPLFLSPALPQHPQVTPPLFLSPTLPQYPQVTPPLFLSPAFPQHPQVTPPLFLSPTLPQHPQVTPPLFLSPAFPQYPQVTPPLFLSPTLPQHPQVTPPLFLSPTLPQYPQVTPPLFMSPMLSSVSTGDTTPLPVTSPSSASTGDTTPLPVTDTSSVSTRRHHPSSCHRHFLSIHKPRHLSSCHRHFLSIHKPRHLSSCHRPFLSIHR

SEQ ID NO: 1030109 - protein, 1107 aa, Homo sapiens
KAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTQTHTLSPSGSGKTFTTALISNATPLPVTYASSASTGHTTPLHVTDASSVSTGHATPLPVTDTSSASTGHATPLPVTSPSSASTGHATPLPVTDTSSVSTGQTPPLFLSPTLPQYPQVTPPLFLSPALPQHPQVTPPLFLSPTLPQHPQVTPPLFLSPAFPQYPQVTPPLFLSLALPQHPQVTPPLFLSPTLPQHPQVTPPLFLSPALPQHPQVTHPDEAYSPFRRSSLGSPLESPR

SEQ ID NO: 1030110 - protein, 1223 aa, Homo sapiens
KAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTQTHTLSPSGSGKTFTTALISNATPLPVTYASSASTGHTTPLHVTDASSVSTGHATPLPVTDTSSASTGHATPLPVTSPSSASTGHATPLPVTDTSSVSTGDTTPLPVTDASSVASTGDTTPFMSPTLPQHPQVTPPLFLSPAFPQYPQVTPRLFLSLALPQHPQVTPPLFLSPTLPQYPQVTPPLFLSPTLPQHPQVTPPLFMSPTLPQHPQVTPPLFLSPTLPQHPQVTPPLFLSPTLPQHPQVTPPLFLSPTLPQHPQVTPPLFMSPTLPQYPQVTPPLFLSPALPQHPQVTPPLFLSPTLPQYPQVTPHPSSCHRHFLSIHRSRHPSFLSAALPQLPQYPRLPSEVYVM

SEQ ID NO: 1030111 - protein, 1388 aa, Homo sapiens
KAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTQTHTLSPSGSGKTFTTALISNATPLPVTYASSASTGHTTPLHVTDAQHPQVTPPLFLSPALPQHPQVTPPLFLSPTLPQYPQVTPPLFLSPTLPQYPQVTPPLFLSPALPQHPQVTPPLFLSPTLPQYPQVRHHPSSCHRRFLSSIQQVTPPLFMSPTLPQHPQVTPPLFLSPAFPQYPQVTPRLFLSLALPQHPQVTPPLFLSPTLPQYPQVTPPLFLSPTLPQHPQVTPPLFMSPTLPQHPQVTPPLFLSPTLPQHPQVTPPLFLSPTLPQHPQVTPPLFLSPTLPQHPQVTPPLFMSPTLPQYPQVTPPLFLSPALPQHPQVTPPLFLSPTLPQYPQVTPPLFLSPAFPQHPQVTPPLFLSPTLPQHPQVTPPLFLSPAFPQYPQVTPPLFLSPTLPQHPQVTPPLFLSPTLPQYPQVTPPLFMSPMLSSVSTGDTTPLPVTSPSSASTGDTTPLPVTDTSSVSTRRHHPSSCHRHFLSIHKPRHLSSCHRHFLSIHKPRHLSSCHRPFLSIHR

SEQ ID NO: 1030112 - protein, 1036 aa, Homo sapiens
KAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTQTHTLSPSGSGKTFTTALISNATPLPVTYASSASTGHTTPLHVTDASSVSTGHATPLPVTDTSSASTGHATPLPVTSPSSASTGHATPLPVTDTSSVSTGQYPQVTPPLFLSLALPQHPQVTPPLFLSPTLPQHPQVTPPLFLSPALPPLRRRGREFSSSSRPPL

SEQ ID NO: 1030113 - protein, 314 aa, Homo sapiens
STTTTKFAGASTRPLHVTDTSSASTGHATPLPVTSLSSVSTGDTTPLPVTSPSSASTGHATPLLVTDASSVSTGHATPLPVTDASSASTGHATPLHVTELPQYPQVTPPLFLSPALPQHPQVTPPLFLSPTLPQYPQVTPPLFLSPAFPQHPQVTPPLFLSPTLPQHPQVTPPLFLSPAFPQYPQVTPPLFLSPTLPQHPQVTPPLFLSPTLPQYPQVTPPLFMSPMLSSVSTGDTTPLPVTSPSSASTGDTTPLPVTDTSSVSTRRHHPSSCHRHFLSIHKPRHLSSCHRHFLSIHKPRHLSSCHRPFLSIHR

SEQ ID NO: 1030114 - protein, 130 aa, Homo sapiens
TLGGAADEVLAVLKIEKLRDKERRGEIDLLLGQTPFTPLPVTSLSSASTGDTTPLPVTDTSSASTGHATPLPVTSLSSVSTGDTTPLPVTDTSSASTGHATSLLVTDASSVSTGHATPLHVTDAFLSIHR

SEQ ID NO: 1030115 - protein, 234 aa, Homo sapiens
STTTTKFAGASTRSASTGHATPLPVTSPSSASTGDTTPLPVTDTSSVSTGHATPLPVTDTSSASTGHATPLPVTSPSSASTGHATPLPVTDTSSVSTGQTPPLFLSPTLPQYPQVTPPLFLSPALPQHPQVTPPLFLSPTLPQHPQVTPPLFLSPAFPQYPQVTPPLFLSLALPQHPQVTPPLFLSPTLPQHPQVTPPLFLSPALPQHPQVTHPDEAYSPFRRSSLGSPLESPR

SEQ ID NO: 1030116 - protein, 208 aa, Homo sapiens
PTSPTASTGQATPLPVTSPSSASTGDATLFLSPALPQHPQVTPPLFLSPALPQHPQVTPPLFLSPTLPQHPQVTPPLFLSPTLPQHPQVTPPLFLSPALPQHPQVTPPLFLSPTLPQHPQVTPPLFLSPAFPQYPQVTPPLFLSLALPQHPQVTPPLFLSPTLPQHPQVTPPLFLSPALPQHPQVTHPDEAYSPFRRSSLGSPLESPR

SEQ ID NO: 1030117 - protein, 1356 aa, Homo sapiens; identical to SEQ ID NO: 1030108

SEQ ID NO: 1030118 - protein, 988 aa, Homo sapiens
KAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTQTHTLSPSGSGKTFTTALISNATPLPVTYASSASTGHTTPLHVTDASSVSTGHATPLPVTDTSSASTGHATPLPVTSPSSASTGHATPLPVTDTSSVSTGRHHPSSCHRRFLSSIHR

SEQ ID NO: 1030119 - protein, 988 aa, Homo sapiens; identical to SEQ ID NO: 1030118

SEQ ID NO: 1030120 - protein, 988 aa, Homo sapiens; identical to SEQ ID NO: 1030118

SEQ ID NO: 1030121 - protein, 1017 aa, Homo sapiens
KAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTQTHTLSPSGSGKTFTTALISNATPLPVTYASSASTGHTTPLHVTDASSVSTGHATPLPVTDTSSASTGHATPLPVTSPSSASTGHATPLPVTDTSSVSTGLFLSPALPQHPQVTPPLFLSPTLPQHPQVTLRRRGREFSSSSRPPL

SEQ ID NO: 1030122 - protein, 205 aa, Homo sapiens
LGTRQTLNYVSTGHATPLPVTDTSSVSTGHATPLPVTSLSSASTGDTTPLPVTDTSSASTGHATPLPVTSLSSVSTGDTTPLPVTDTSSASTGHATSLLVTDASSVSTGHATPLHVTDASSVSTGDTTPLPVTSPSSASTGDTTPLPVTDTSSVSTRRHHPSSCHRHFLSIHKPRHLSSCHRHFLSIHKPRHLSSCHRPFLSIHR

SEQ ID NO: 1030123 - protein, 182 aa, Homo sapiens
QTIGKAAKPEGPIDKIPQCPQVTPPLFLSPTLPQHPQVTPPLFLSPAFPQYPQVTPPLFLSPTLPQHPQVTPPLFLSPTLPQYPQVTPPLFMSPMLSSVSTGDTTPLPVTSPSSASTGDTTPLPVTDTSSVSTRRHHPSSCHRHFLSIHKPRHLSSCHRHFLSIHKPRHLSSCHRPFLSIHR

SEQ ID NO: 1030124 - protein, 109 aa, Homo sapiens
QTLNYVSTGHATPLPVTSLSSASTGDTTPLPVTDTSSASTGHATPLPVTSLSSVSTGDTTPLPVTDTSSASTATPLPVTDTSSASTGHATLLPVRTLHSAHSSASEQGS

SEQ ID NO: 1030125 - protein, 1356 aa, Homo sapiens; identical to SEQ ID NO: 1030108

SEQ ID NO: 1030126 - protein, 988 aa, Homo sapiens; identical to SEQ ID NO: 1030118

SEQ ID NO: 1030127 - protein, 988 aa, Homo sapiens; identical to SEQ ID NO: 1030118

SEQ ID NO: 1030128 - protein, 208 aa, Homo sapiens
MASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 1030129 - protein, 220 aa, Homo sapiens
GTRPRAKLARGTMASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 1030130 - protein, 320 aa, Homo sapiens
GRQVLERGQVLERWAGSSTGPFTAGTEGTNSDKPLVPLLKWLGSSGVPVLGGAETQRENRAWGDVAPPGLRRRGMGPPGGMEGACGDLLKVVDPRSCVGVVAASVGAEGVRGCAPCLTPLPPLPLQAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 1030131 - protein, 218 aa, Homo sapiens
GRQVLERGQVLERWAGSSTGPFTAAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 1030132 - protein, 306 aa, Homo sapiens
KLGTRDRRAGGAGRGRRRPGGERAEGAGRPGAPTMASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVMMWAHLRPRPCRGPPAWLCWESAQPPSPACKPRASIGGGAATGRAPCCPSPSLWCVCPLWHPLGVP

SEQ ID NO: 1030133 - protein, 208 aa, Homo sapiens; identical to SEQ ID NO: 1030128

SEQ ID NO: 1030134 - protein, 308 aa, Homo sapiens
MEMAVAAGCVCKGGGCCHREPSQDHHESQEHRGPLVGSQTCLVHQAEGTAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVGLMMWVTCAPDLQGAPAWLCWESAQPPSPACKPRASIGGGAATGRAPCCPSPSLWCVCPLWHPLGVP

SEQ ID NO: 1030135 - protein, 242 aa, Homo sapiens
KLGTRDRRAGGAGRGRRRPGGERAEGAGRPGAPTMASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 1030136 - protein, 281 aa, Homo sapiens
KLGTRDRRAGGAGRGRRRPGGERAEGAGRPGAPTMASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIHDPFCVCVSESPCDPVPAFSRRPCVSPWRCPLSLSCCPPTCQCYLCSLRG

SEQ ID NO: 1030137 - protein, 306 aa, Homo sapiens; identical to SEQ ID NO: 1030132

SEQ ID NO: 1030138 - protein, 80 aa, Homo sapiens
AWHEGQTGRRGWARAAAARRRTGGGRGPTGRTDHGLQMPQVRQDRVLRREGELPGEGLAQVLPQVRALQQDADARGPRRA

SEQ ID NO: 1030139 - protein, 128 aa, Homo sapiens
KLGTRDRRAGGAGRGRRRPGGERAEGAGRPGAPTMASKCPKCDKTVYFAEKVSSLGKDWHKFCLKCAVALSALPLLLPTHLPVLFMLPSWVMATPSPCPWQRASLRDPLPGAHTASQALATLTWLTCC

SEQ ID NO: 1030140 - protein, 186 aa, Homo sapiens
MASKCPKCDKTVYFAEKVSSLGKDWHKFCLKCERCSKTLTPGGHAEHDGKPFCHKPCYATLFGPKGELRLPSACPGTCWEGRGAGAGEGWGSRPPWIPAQSPCHPGKPSAPQSPAGRFLRCPVAAADNRKSDTVRHHRQHGVDEDKEDRRITIRETLNHSSHTAALTVNKTMQEQQRTENPRDDQP

SEQ ID NO: 1030141 - protein, 286 aa, Homo sapiens
KLGTRDRRAGGAGRGRRRPGGERAEGAGRPGAPTMASKCPKCDKTVYFAEKVSSLGKDWHKFCLKCERCSKTLTPGGHAEHDGKPFCHKPCYATLFGPKGKAVNIGGAGSYIYEKAPGGGGPARSTGPPFGGPPAGPRAEGKPGKGAKAGPPRKGAPGQKALPRCSPPTFHRGEGPQTRFAPGPWKHRKRGSLPGVNTRDEPSLYGGQGILAARGPGALGLVADGPPFARGKETPVSPPRGAALPRESGALSFPRRVGFTPPGLRGWGTSHLFFMTRGNPPMGTGV

SEQ ID NO: 1030142 - protein, 243 aa, Homo sapiens
MEMAVAAGCVCKGGGCCHREPSQDHHESQEHRGPLVGSQTCLVHQAEGTAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 1030143 - protein, 243 aa, Homo sapiens; identical to SEQ ID NO: 1030142

SEQ ID NO: 1030144 - protein, 272 aa, Homo sapiens
KLGTRDRRAGGAGRGRRRPGGERAEGAGRPGAPTMASKCPKCDKTVYFAEKVSSLGKDWHKFCLKCERCSKTLTPGGHAEVSPTARRGRGRGSRLPPPSGRVLTRAPLQQHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 1030145 - protein, 242 aa, Homo sapiens
KLGTRDRRAGGAGRGRRRPGGERAEGAGRPGAPTMASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVVS

SEQ ID NO: 1030146 - protein, 146 aa, Homo sapiens
VLLGAACPLPHGEPACTFWKPPGDGSGESVDSSLSTHLLPQHDGQPYCHKPCYGILFGPKGVNTGAVGSYIYDRDPEGKVMMWAHLRPRPCRGPPAWLCWESAQPPSPACKPRASIGGGAATGRAPCCPSPSLWCVCPLWHPLGVP

SEQ ID NO: 1030147 - protein, 273 aa, Homo sapiens
KLGTRDRRAGGAGRGRRRPGGERAEGAGRPGAPTMASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTHLPVLFMLPSWVMATPSPCPWQRASLRDPLPGAHTASQALATLTWLTCC

SEQ ID NO: 1030148 - protein, 242 aa, Homo sapiens; identical to SEQ ID NO: 1030135

SEQ ID NO: 1030149 - protein, 196 aa, Homo sapiens
KLGTRDRRAGGAGRGRRRPGGERAEGAGRPGAPTMASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCQALATLTWLTCC

SEQ ID NO: 1030150 - protein, 150 aa, Homo sapiens
MASKCPKCDKTVYFAEKVSSLGKDWHKFCLKCERCSKTLTPGGHAEHDGKPFCHKPCYATLFGPKGELRLPSACPGTCWEGRGAGAGEGWGSRPPWIPAQSPCHPLGKAKVPHPRSPMRGRLFLKNRAGWHLRAGDQDRENRQEDDVRDK

SEQ ID NO: 1030151 - protein, 208 aa, Homo sapiens; identical to SEQ ID NO: 1030128

SEQ ID NO: 1030152 - protein, 208 aa, Homo sapiens; identical to SEQ ID NO: 1030128

SEQ ID NO: 1030153 - protein, 698 aa, Homo sapiens
MVEPGQDLLLAALSESGISPNDLFDIDGGDAGLATPMPTPSVQQSVPLSALELGLETEAAVPVKQEPETVPTPALLNVRQQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAKGVLQSLIEKHFPAPDRKKLYSLLGIDLTAPSKNSSPRDSL

SEQ ID NO: 1030154 - protein, 658 aa, Homo sapiens
MVEPGQDLLLAALSESGISPNDLFDIDGGDAGLATPMPTPSVQQSVPLSALELGLETEAAVPVKQEPETVPTPALLNVRQQPPSTTTFVLNQINHLPPLGSTIVMTKTPPVTTNRQTITLTKFIQTTASTRPSVSAPTVRNAMTSAPSKDQVQLKDLLKNNSLNELMKLKPPANIAQPVATAATDVSNGTVKKESSNKEGARMWINDMKMRSFSPTMKVPVVKEDDEPEEEDEEEMGHAETYAEYMPIKLKIGLRHPDAVVETSSLSSVTPPDVWYKTSISEETIDNGWLSALQLEAITYAAQQHETFLPNGDRAGFLIGDGAGVGKGRTIAGIIYENYLLSRKRALWFSVSNDLKYDAERDLRDIGAKNILVHSLNKFKYGKISSKHNGSVKKGVIFATYSSLIGESQSGGKYKTRLKQLLHWCGDDFDGVIVFDECHKAKNLCPVGSSKPTKTGLAVLELQNKLPKARVVYASATGASEPRNMAYMNRLGIWGEGTPFREFSDFIQAVERRGVGAMEIVAMDMKLRGMYIARQLSFTGVTFKIEEVLLSQSYVKMYNKAVKLWVIARERFQQAADLIDAEQRMKKSMWGQFWSAHQRFFKYLCIASKVKRVVQLAREEIKNGKCVVIGLQSTGEARTLEALEEGGGELNDFVSTAK

SEQ ID NO: 1030155 - protein, 698 aa, Homo sapiens; identical to SEQ ID NO: 1030153

SEQ ID NO: 1030156 - protein, 74 aa, Homo sapiens
DTMISGLWIQILDGRGGWIHNAAATVHSNPRWLRRGISPFTSTRSPLLGMSKCVCECVYTYMCTHCLHTNHLDL

SEQ ID NO: 1030157 - protein, 123 aa, Homo sapiens
GSPGLQARAEFGTRKPVSTKRDAQCPTGQDGKPSLGPLCAHSSGLPSFLWASHHPTLVSLSCLVLRTQEGPGWGPACVYPRLLSSQQAPGKEASHCCCYRFSTPTLTDAQIPVVRHRRHTHTS

SEQ ID NO: 1030158 - protein, 123 aa, Homo sapiens; identical to SEQ ID NO: 1030157

SEQ ID NO: 1030159 - protein, 123 aa, Homo sapiens; identical to SEQ ID NO: 1030157

SEQ ID NO: 1030160 - protein, 646 aa, Homo sapiens
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPGEGITLCVYARFVFGGRCRLHACKFSTCCHGPQELVLFFSLKNSATEFDVSLPEVF

SEQ ID NO: 1030161 - protein, 438 aa, Homo sapiens
EEVEGHHTIYIGVHVPKYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRESAIFCQ

SEQ ID NO: 1030162 - protein, 422 aa, Homo sapiens
VDGDSPTAGVWRVSWALLSLEPSFDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPGEGITLCVYARFVFGGRCRLHACKFSTCCHGPQELVLFFSLKNSATEFDVSLPEVF

SEQ ID NO: 1030163 - protein, 1172 aa, Homo sapiens
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIGPVALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGFCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 1030164 - protein, 315 aa, Homo sapiens
GGDGIQYRGAGLGPLQQPCTGEAAYKAALPGSRSATSTGASCTAGPVSRSSRACAFLTRSGTLKPVITASFWQTRSSAAGGRMVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGGR

SEQ ID NO: 1030165 - protein, 143 aa, Homo sapiens
QGTPLTGKYPSEAAQPDLSLLLVLVRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVGE

SEQ ID NO: 1030166 - protein, 1256 aa, Homo sapiens
GGDGIQYRGAGLGPLQQPCTGEAAYKAALPGSRSATSTGASCTAGPVSRSSRACAFLTRSGTLKPVITASFWQTRSSAAGGRMVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGFCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECTEMNI

SEQ ID NO: 1030167 - protein, 305 aa, Homo sapiens
GGDGIQYRGAGLGPLQQPCTGEAAYKAALPGSRSATSTGASCTAGPVSRSSRACAFLTRSGTLKPVITASFWQTRSSAAGGRMVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRVRSAGRWPPVRGGKELKLGT

SEQ ID NO: 1030168 - protein, 1254 aa, Homo sapiens
GGDGIQYRGAGLGPLQQPCTGEAAYKAALPGSRSATSTGASCTAGPVSRSSRACAFLTRSGTLKPVITASFWQTRSSAAGGRMVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGFCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 1030169 - protein, 89 aa, Homo sapiens
GGDGIQYRGAGLGPLQQPCTGEAAYKAALPGSRSATSTGASCTAGPVSRSSRACAFLTRSGTLKPVITASFWQTRYDYFLNSINYLMVL

SEQ ID NO: 1030170 - protein, 503 aa, Homo sapiens
MPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGHLVELGNVDYLDPKDLVVTKVIMETEATEVRRATEALLVFRVFLALLVQMVNKEVLESLDHLAQEVLQAQLVLQVKKETLGHLGQLDLQVYEAVVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 1030171 - protein, 1340 aa, Homo sapiens
PQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGPKGPTGSPGTSGPPGSAGPPGSPGPQGSTGPQGNSGLPGDPGFKGEAGPKGEPGPHGIQGPIGPPGEEGKRGPRGDPGTLGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIKGQPGTMGLPGPKGSNGDPGKPGEAGNPGVPGQRGAPGKDGKVGPYGPPGPPGLRGERGEQGPPGPTGFQGHPGPPGPPGEGGKPGDQGVPGGPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGAGGLPGPLGPPGPAGLLGEKGEPGPRGLVGPPGSRGNPGSRGENGPTGAVGFAGPQGSDGQPGVKGEPGEPGQKGDAGSPGPQGLAGSPGPHGPNGVPGLKGGRGTQGPPGATGFPGSAGRVGPPGPAGAPGPAGPLGEPGKEGPPGPRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGHLVELGNVDYLDPKDLVVTKVIMETEATEVRRATEALLVFRVFLALLVQMVNKEVLESLDHLAQEVLQAQLVLQVKKETLGHLGQLDLQVYEAVVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 1030172 - protein, 1340 aa, Homo sapiens; identical to SEQ ID NO: 1030171

SEQ ID NO: 1030173 - protein, 78 aa, Homo sapiens
PGPINVGIDSWPGTDTDPKSAHIVLQDTCSKRNGNVGKTVFEYRTQNVARLPIIDLAPVDVGGTDQEFGVEIGPVCFV

SEQ ID NO: 1030174 - protein, 1340 aa, Homo sapiens; identical to SEQ ID NO: 1030171

SEQ ID NO: 1030175 - protein, 1340 aa, Homo sapiens; identical to SEQ ID NO: 1030171

SEQ ID NO: 1030176 - protein, 1340 aa, Homo sapiens; identical to SEQ ID NO: 1030171

SEQ ID NO: 1030177 - protein, 1340 aa, Homo sapiens; identical to SEQ ID NO: 1030171

SEQ ID NO: 1030178 - protein, 1340 aa, Homo sapiens; identical to SEQ ID NO: 1030171

SEQ ID NO: 1030179 - protein, 1340 aa, Homo sapiens; identical to SEQ ID NO: 1030171

SEQ ID NO: 1030180 - protein, 693 aa, Homo sapiens
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030181 - protein, 698 aa, Homo sapiens
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLETAHPEEGKPDKILPPTIPFALLLS

SEQ ID NO: 1030182 - protein, 315 aa, Homo sapiens
LEDPLCLIVRVLFVVISVLVIVSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030183 - protein, 252 aa, Homo sapiens
IESSWLPYIRVPLTSGDTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030184 - protein, 622 aa, Homo sapiens
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDLTRISFSGDR

SEQ ID NO: 1030185 - protein, 546 aa, Homo sapiens
SPLLRRGGLSWKPWGQMAGIEGHAVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030186 - protein, 526 aa, Homo sapiens
IPEDNTRTLMYNEQNPNNNGRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030187 - protein, 390 aa, Homo sapiens [sequence omitted]

SEQ ID NO: 1030188 - protein, 298 aa, Homo sapiens
MSTPPPTNPILSHSLPYSKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030189 - protein, 257 aa, Homo sapiens
ELICLASLGSIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030190 - protein, 246 aa, Homo sapiens
VRNRRLGEGSFQPPAGHQHGEGNSALSPLNPGEPPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030191 - protein, 466 aa, Homo sapiens
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDNEITDI

SEQ ID NO: 1030192 - protein, 482 aa, Homo sapiens
MESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030193 - protein, 735 aa, Homo sapiens
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEVGPFLASPEKALLGLFLGAGELRGGSGACTNGCLIPSPLFQQIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030194 - protein, 324 aa, Homo sapiens
MAVLFLLPFLQQIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHETTDNNESADDNNENPEDNNKNTDDNEENPNNNENTYGNNFFKGGFWGSHGNNQDSSDSDNEADEASDDEDNDGNEGDNEGSDDDGNEGDNEGSDDDDRDIEYYEKVIEDFDKDQADYEDVIEIISDESVEEEGIEEGIQQDEDIYEEGNYEEEGSEDVWEEGEDSDDSDLEDVLQVPNGWANPGKRGKTG

SEQ ID NO: 1030195 - protein, 515 aa, Homo sapiens
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERRDLIIQHIPGFWVKAFLNHPRISILINRRDEDIFRYLTNLQVQDLRHISMGYKMKLYFQTNPYFTNMVIVKEFQRNRSGRLVSHSTPIRWHRGQEPQARRHGNQDASHSFFSWFSNHSLPEADRIAEIIKNDLWVNPLRYYLRERGSRIKRKKQEMKKRKTRGRCEVVIMEDAPDYYAVEDIFSEISDIDETIHDIKISDFMETTDYFETTDNEITDINENICDSENPDHNEVPNNETTDNNESADDHPGILHHHPDSSVP

SEQ ID NO: 1030196 - protein, 277 aa, Homo sapiens
MCEPECKTQLTASTWRSGTPGHTGPYAGSLWDPKPLWVVLGDSSSWAFPANCHRCLCYSAFLHLGQNNFAEAHRFFTEILRMDPRNAVVRSPSCRILHPLPFTDARNIHPHTSQQGPARSLSSPPAPGSGCGPSGEVTQQGHLGSAQQLCTTPRPLTRPSTQPGMGGRLSWLCGPTLGVCSSLGQQQRCRVSALPGQAQGLPAAAGGHGPAGPQALPARERALQPDHHVRAGVLTEHAEETGPAGGCRRQGGGQLQHTVPQAGLAASNTLRQKDPGL

SEQ ID NO: 1030197 - protein, 581 aa, Homo sapiens
VPASGLSRTRRAAARHAQAYRAARGCQFLSDSRLLSPSSRTLVTAAGDPLAQLQWAGGRVMEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMGEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILAPYCRHLTG

SEQ ID NO: 1030198 - protein, 97 aa, Homo sapiens
RPPTTTKFAAASTRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 1030199 - protein, 379 aa, Homo sapiens
MLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPVGNLDQPDLYYEYYPHVYPGRRGSMVPFSMRILHADLQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 1030200 - protein, 379 aa, Homo sapiens; identical to SEQ ID NO: 1030199

SEQ ID NO: 1030201 - protein, 660 aa, Homo sapiens
VPASGLSRTRRAAARHAQAYRAARGCQFLSDSRLLSPSSRTLVTAAGDPLAQLQWAGGRVMEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMGEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQRVPSPRAE

SEQ ID NO: 1030202 - protein, 373 aa, Homo sapiens
GGGKNNLPRLWPMAPGFNRHRGKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 1030203 - protein, 659 aa, Homo sapiens
VPASGLSRTRRAAARHAQAYRAARGCQFLSDSRLLSPSSRTLVTAAGDPLAQLQWAGGRVMEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMGEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQVPVHGQT

SEQ ID NO: 1030204 - protein, 638 aa, Homo sapiens
VPASGLSRTRRAAARHAQAYRAARGCQFLSDSRLLSPSSRTLVTAAGDPLAQLQWAGGRVMEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMGEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKKVSFVLPIFVEGVFFTSWF

SEQ ID NO: 1030205 - protein, 211 aa, Homo sapiens
MSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 1030206 - protein, 185 aa, Homo sapiens
MANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 1030207 - protein, 219 aa, Homo sapiens
LKLDCRSPCWLQNGCKSSFTACKHVWLLKRNGEDGAKIDLSLEDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 1030208 - protein, 168 aa, Homo sapiens [sequence omitted]

SEQ ID NO: 1030209 - protein, 115 aa, Homo sapiens [sequence omitted]

SEQ ID NO: 1030210 - protein, 129 aa, Homo sapiens
MCAKYECVLSYGKQTQLSTDWIPGSMVPFSMRILHAELQQYLGNPQESLDRLHKVKTVCSKILALSFFPATGRTCPPRPPHRTCPCCSLPVLPHAPSAASAFRRLGDPGLCGLVVVALAEIFFRDGKSF

SEQ ID NO: 1030211 - protein, 904 aa, Homo sapiens
VPASGLSRTRRAAARHAQAYRAARGCQFLSDSRLLSPSSRTLVTAAGDPLAQLQWAGGRVMEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMGEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVVRSPSCRILHPLPFTDARNIHPHTSQQGPARSLSSPPAPGSGCGPSGEVTQQGHLGSAQQLCTTPRPLTRPSTQPGMGGRLSWLCGPTLGVCSSLGQQQRCRVSALPGQAQGLPAAAGGHGPAGPQALPARERALQPDHHVRAGVLTEHAEETGPAGGCRRQGGGQLQHTVPQAGLAASNTLRQKDPGL

SEQ ID NO: 1030212 - protein, 469 aa, Homo sapiens
GQPKGVGDGGLQCDCCLGTCTPRSPEFLSCLQEERDYADNQSVRRADKSFIEHKTALSREGRRGWSPTESQVVSLPVWLAQGLFWAQNGGVHADCEYAKKKAKTKSPPKVGTTVEKTSWGRGDAVKDLMLRFLGEKAAAKRQVLNADSVEQSFVGLKQLILWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVEAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 1030213 - protein, 630 aa, Homo sapiens
VPASGLSRTRRAAARHAQAYRAARGCQFLSDSRLLSPSSRTLVTAAGDPLAQLQWAGGRVMEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMGEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQVENNFQVLEFNLAYHSLGTWTGPWPFMPITKSMFSYPASFSPNYIVYTILGHWNSHFGPSGRLCAPEARSQVPTLSLMVEPAWLWVSRWVRLTTGSSNWPVRGSGACLGPVGNSDRSSWFCPPQGRRVHVPFAPRGISLAIKIH

SEQ ID NO: 1030214 - protein, 211 aa, Homo sapiens; identical to SEQ ID NO: 1030205

SEQ ID NO: 1030215 - protein, 147 aa, Homo sapiens [sequence omitted]

SEQ ID NO: 1030216 - protein, 379 aa, Homo sapiens; identical to SEQ ID NO: 1030199

SEQ ID NO: 1030217 - protein, 379 aa, Homo sapiens; identical to SEQ ID NO: 1030199

SEQ ID NO: 1030218 - protein, 240 aa, Homo sapiens
WRSVSPALTAPRRKPVGTQTHRRPASPLGLARPRAMEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHDNPQEKRLAADDPEVRVLHSIGHSAAPRLFPLAWTVLLLPLLLLQTP

SEQ ID NO: 1030219 - protein, 218 aa, Homo sapiens
WRSVSPALTAPRRKPVGTQTHRRPASPLGLARPRAMEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISHSPQAHDNPQEKRLAADDPEVRVLHSIGHSAAPRLFPLAWTVLLLPLLLLQTP

SEQ ID NO: 1030220 - protein, 227 aa, Homo sapiens
WRSVSPALTAPRRKPVGTQTHRRPASPLGLARPRAMEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKISECRSPVGLLPPSLCWVRSSDLGWYRSLAAQPTHTYSPLPL

SEQ ID NO: 1030221 - protein, 227 aa, Homo sapiens; identical to SEQ ID NO: 1030220

SEQ ID NO: 1030222 - protein, 240 aa, Homo sapiens; identical to SEQ ID NO: 1030218

SEQ ID NO: 1030223 - protein, 233 aa, Homo sapiens
MAERNVRHQDQYILGVETSEKSLGVQCEDVRGHVNIQRPKDLAWLLNDHLLLPPVCVPRFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHDNPQEKRLAADDPEVRVLHSIGHSAAPRLFPLAWTVLLLPLLLLQTP

SEQ ID NO: 1030224 - protein, 248 aa, Homo sapiens
WRSVSPALTAPRRKPVGTQTHRRPASPLGLARPRAMEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKIITVLRPMTIHRRRDLQQMTQRCGFYIASVTVLPHASSHLPGLCCSFHFCCCKPREGVCHTWP

SEQ ID NO: 1030225 - protein, 240 aa, Homo sapiens; identical to SEQ ID NO: 1030218

SEQ ID NO: 1030226 - protein, 240 aa, Homo sapiens; identical to SEQ ID NO: 1030218

SEQ ID NO: 1030227 - protein, 133 aa, Homo sapiens
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYICECL

SEQ ID NO: 1030228 - protein, 205 aa, Homo sapiens
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHVNPQEKRLAADDPEVRVLHSIGHSAAPRLFPLAWTVLLLPLLLLQTP

SEQ ID NO: 1030229 - protein, 205 aa, Homo sapiens; identical to SEQ ID NO: 1030228

SEQ ID NO: 1030230 - protein, 240 aa, Homo sapiens; identical to SEQ ID NO: 1030218

SEQ ID NO: 1030231 - protein, 817 aa, Homo sapiens
LSRRGRKRRRKHRAKKEKKTKRRKKGEGDGGQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQALTTILADEMGLGKTYNTIVFLYSLYKEGHTKGPFLVVPISTIINWEREFQMWDPKFYAGMTIQRGDKDQTGAIHSREAMEILPLEGQRHPEGGARKAYTCTGTTHETSTRQPTNRHATQPHDHRRGGSPRGTVAPHRRRHTTQATTPELTGEPHTTATHTQM

SEQ ID NO: 1030232 - protein, 710 aa, Homo sapiens
WAPLKIKLGLLGGKRKKGGSSDEGPEPEAEESDLDMAVSTVPQAGLMALSAPIRRAKTKEGKGPGHKRRSKSPRVPDGRKKLRGKKMAPLKIKLGLLGGKRKKGGSSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQALTTILADEMGLGKTYNTIVFLYSLYKEGHTKGPFLVVPISTIINWEREFQMWDPKFYAGMTIQRGDKDQTGAIHSREAMEILPLEGQRHPEGGARKAYTCTGTTHETSTRQPTNRHATQPHDHRRGGSPRGTVAPHRRRHTTQATTPELTGEPHTTATHTQM

SEQ ID NO: 1030233 - protein, 665 aa, Homo sapiens
SSSRFPFIRRAKTKEGKGPGHKRRSKSPRVPDGRKKLRGKKMAPLKIKLGLLGGKRKKGGSSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQALTTILADEMGLGKTVQTIVFLYSLYKEGHTKGPFLVMPISTIINWEREFQMWDPKFYAGMTIQRGDKDQTGAIHSREAMEILPLEGQRHPEGGARKAYTCTGTTHETSTRQPTNRHATQPHDHRRGGSPRGTVAPHRRRHTTQATTPELTGEPHTTATHTQM

SEQ ID NO: 1030234 - protein, 1282 aa, Homo sapiens
ELVQPRTVGVDRLHSCLSQWTKTSRKWVKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTIPREATGYIYDCEQRVFHTRQSETDVNFQDQRRLVQVQLCPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESK

SEQ ID NO: 1030235 - protein, 1115 aa, Homo sapiens
IPCLDVLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTIPREATGYIYDCEQRVFHTRQSETDVNFQDQRRLVQVQLCPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESK

SEQ ID NO: 1030236 - protein, 596 aa, Homo sapiens
YSVMEVISGRVGKSSSGPEIESGSRTTLLTFCKSLELTTTTPGQNSQLQKISFRFFFNHSFMFQSNRNGSSFLFTGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVQSSTQTLSSGQTLNQVTVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESK

SEQ ID NO: 1030237 - protein, 1404 aa, Homo sapiens
KGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTIPREATGYIYDCEQRVFHTRQSETDVNFQDQRRLVQVQLCPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESK

SEQ ID NO: 1030238 - protein, 1404 aa, Homo sapiens; identical to SEQ ID NO: 1030237

SEQ ID NO: 1030239 - protein, 1547 aa, Homo sapiens
KGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTIPREATGYIYDCEQRVFHTRQSETDVNFQDQRRLVQVQLCPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVQSSTQTLSSGQTLNQVTVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESK

SEQ ID NO: 1030240 - protein, 1064 aa, Homo sapiens
KGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTIPREATGYIYDCEQRVFHTRQSETDVNFQDQRRLVQVQLCPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGRAVGLSEMSDVTTTRGWANRGQQENQYLPLEGYASSQ

SEQ ID NO: 1030241 - protein, 611 aa, Homo sapiens
KGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTIPREATGYIYDCEQRVFHTRQSETDVNFQDQRRLVQVQLCPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTGKRGRELFV

SEQ ID NO: 1030242 - protein, 1500 aa, Homo sapiens
KGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTIPREATGYIYDCEQRVFHTRQSETDVNFQDQRRLVQVQLCPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVQSSTQTLSSGQTLNQVTVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQVRGHILFFCVQCLTSEVLLFSLAFLIKLKISVCFLGTYICVHRVKKAVQPCVFFAKTSSGLFNLN

SEQ ID NO: 1030243 - protein, 1202 aa, Homo sapiens
KGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTIPREATGYIYDCEQRVFHTRQSETDVNFQDQRRLVQVQLCPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPLSQIPSYFISQTKFLNKGKVRWLMPVIPALWEAEAGRIMRSGDPDHPG

SEQ ID NO: 1030244 - protein, 401 aa, Homo sapiens
ERGERTDATRRAPPRLRYENESRSGPAPAAPGPRPPEDRRQAAPPSPQLAPGRRRLAGPGRKGAGSRFAPPPRRDTRRRGPKPPGEAAGAGEALRLLRVYAVPAGLPGPLRRADRLGLGRPVSPARRSPGSAAASAPGARGSGEAVARDAALQVRLPGAPLRARRRGPPPGEDPAARYARGRRGRGRGQGGDRGRPGPHQPRPRLPAAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGERGRGAGNVPGPLPAG

SEQ ID NO: 1030245 - protein, 326 aa, Homo sapiens
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGAPESCDLRLCTLDPDDVASTTSSSESL

SEQ ID NO: 1030246 - protein, 356 aa, Homo sapiens
MPRGSRSAGSAASQPAGPCGSGAPGRPSPAMLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGAPESCDLRLCTLDPDDVASTTSSSESL

SEQ ID NO: 1030247 - protein, 326 aa, Homo sapiens; identical to SEQ ID NO: 1030245

SEQ ID NO: 1030248 - protein, 326 aa, Homo sapiens; identical to SEQ ID NO: 1030245

SEQ ID NO: 1030249 - protein, 155 aa, Homo sapiens
LLPVTEARELTSRDSPSVERLCLCGGRAKPCVPLGTRVYSPPEWIRYHRYHGRSATVWSLGVLLYDMVCGDIPFEQDEEILRGRLLFRRRVSPECQQLIRWCLSLRPSERPSLDQIAAHPWMLGADGGAPESCDLRLCTLDPDDVASTTSSSESL

SEQ ID NO: 1030250 - protein, 114 aa, Homo sapiens
MVCGDIPFEQDEEILRGRLLFRRRVSPGAVVARGGGGGLALPGPSLTSPLRTECQQLIRWCLSLRPSERPSLDQIAAHPWMLGADGGAPESCDLRLCTLDPDDVASTTSSSESL

SEQ ID NO: 1030251 - protein, 326 aa, Homo sapiens; identical to SEQ ID NO: 1030245

SEQ ID NO: 1030252 - protein, 326 aa, Homo sapiens; identical to SEQ ID NO: 1030245

SEQ ID NO: 1030253 - protein, 144 aa, Homo sapiens
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERDAPRP

SEQ ID NO: 1030254 - protein, 326 aa, Homo sapiens; identical to SEQ ID NO: 1030245

SEQ ID NO: 1030255 - protein, 279 aa, Homo sapiens
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWRLPWVDT

SEQ ID NO: 1030256 - protein, 155 aa, Homo sapiens; identical to SEQ ID NO: 1030249

SEQ ID NO: 1030257 - protein, 326 aa, Homo sapiens; identical to SEQ ID NO: 1030245

SEQ ID NO: 1030258 - protein, 505 aa, Homo sapiens
ERGERTDATRRAPPRLRYENESRSGPAPAAPGPRPPEDRRQAAPPSPQLAPGRRRLAGPGRKGAGSRFAPPPRRDTRRRGPKPPGEAAGAGEALRLLRVYAVPAGLPGPLRRADRLGLGRPVSPARRSPGSAAASAPGARGSGEAVARDAALQVRLPGAPLRARRRGPPPGEDPAARYARGRRGRGRGQGGDRGRPGPHQPRPRLPAAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGAPESCDLRLCTLDPDDVASTTSSSESL

SEQ ID NO: 1030259 - protein, 532 aa, Homo sapiens
ERGERTDATRRAPPRLRYENESRSGPAPAAPGPRPPEDRRQAAPPSPQLAPGRRRLAGPGRKGAGSRFAPPPRRDTRRRGPKPPGEAAGAGEALRLLRVYAVPAGLPGPLRRADRLGLGRPVSPARRSPGSAAASAPGARGSGEAVARDAALQVRLPGAPLRARRRGPPPGEDPAARYARGRRGRGRGQGGDRGRPGPHQPRPRLPAAKADKESFEKAYQVGAVLGSGGFGTVYAGSRIADGLPVSRTAGRAGFLARLAPRLAGLTPASPQVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPECQQLIRWCLSLRPSERPSLDQIAAHPWMLGADGGAPESCDLRLCTLDPDDVASTTSSSESL

SEQ ID NO: 1030260 - protein, 326 aa, Homo sapiens; identical to SEQ ID NO: 1030245

SEQ ID NO: 1030261 - protein, 326 aa, Homo sapiens; identical to SEQ ID NO: 1030245

SEQ ID NO: 1030262 - protein, 326 aa, Homo sapiens; identical to SEQ ID NO: 1030245

SEQ ID NO: 1030263 - protein, 326 aa, Homo sapiens; identical to SEQ ID NO: 1030245

SEQ ID NO: 1030264 - protein, 351 aa, Homo sapiens
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGTRVYSPPEWIRYHRYHGRSATVWSLGVLLYDMVCGDIPFEQDEEILRGRLLFRRRVSPGAWWLEAGVGASPCLGSSLTSPLRTECQQLIRWCLSLRPSERPSLDQIAAHPWMLGADGGAPESCDLRLCTLDPDDVASTTSSSESL

SEQ ID NO: 1030265 - protein, 222 aa, Homo sapiens
MLLSKFGSLAHLCGPGGVDHLPVKILQPAKADKESFEKAYQVGAVLGSGGFGTVYAGSRIADGLPVAVKHVVKERVTEWGSLGGATVPLEVVLLRKVGAAGGARGVIRLLDWFERPDGFLLVLERPEPAQDLFDFITERGALDEPLARRFFAQVLAAVRHCHSCGVVHRDIKDENLLVDLRSGELKLIDFGSGALLKDTVYTDFDGERGRGAGNVPGPLPAG

SEQ ID NO: 1030266 - protein, 301 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEVWYKGRRPSHRRLWSCALKVGPELGLNLEKLGCWASIQAPDENPGRGGTPGGRAGTNGKRRGGQKNGGRANDRRHRKKARPSAAPPGRTAMQG

SEQ ID NO: 1030267 - protein, 452 aa, Homo sapiens
MAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTGIEMFHKSLERAEAGDNLGALVRGLKREDLRRGLVMVKPGSIKPHQKVEAQVYILSKEEGGRHKPFVSHFMPVMFSLTWDMACRIILPPEKELAMPGEDLKFNLILRQPMILEKGQRFTLRDGNRTIGTGLVTNTLAMTEEEKNIKWG

SEQ ID NO: 1030268 - protein, 452 aa, Homo sapiens; identical to SEQ ID NO: 1030267

SEQ ID NO: 1030269 - protein, 452 aa, Homo sapiens; identical to SEQ ID NO: 1030267

SEQ ID NO: 1030270 - protein, 211 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEVWL

SEQ ID NO: 1030271 - protein, 145 aa, Homo sapiens [sequence omitted]

SEQ ID NO: 1030272 - protein, 309 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEFGYKGEETPVIVGSALCALEGRDPELGLKSVQKLLDAVDTYIPVPARDLEKPFLLPVEAVYSVPGRGTVVTGTLERGILKKGDECELLGHSKNIRTVVTRH

SEQ ID NO: 1030273 - protein, 145 aa, Homo sapiens [sequence omitted]

SEQ ID NO: 1030274 - protein, 145 aa, Homo sapiens [sequence omitted]

SEQ ID NO: 1030275 - protein, 303 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEVWYKGRRPSHRGPSLALRSDLKLAEVGKSYGCGDLFMPRPENFGAVERYPPAGRGGTKGLNGRGPNKTLGYQRGTDTGTKAKREQASYGLRRAAA

SEQ ID NO: 1030276 - protein, 342 aa, Homo sapiens
RLGRGWGKSAEEVPSSRRRPSSSVRSGSWSRLPGYRGASMTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSEMVELVELEIRELLTEVWYKGRRPSHRGPSLALRSDLKLAEVGKSYGCGDLFMPRPENFGAVERYPPAGRGGTKGLNGRGPNKTLGYQRGTDTGTKAKREQASYGLRRAAA

SEQ ID NO: 1030277 - protein, 211 aa, Homo sapiens; identical to SEQ ID NO: 1030270

SEQ ID NO: 1030278 - protein, 211 aa, Homo sapiens; identical to SEQ ID NO: 1030270

SEQ ID NO: 1030279 - protein, 320 aa, Homo sapiens
MTTMAAATLLRATPHFSGLAAGRTFLLQGLLRLLKAPALPLLCRGLAVEAKKTYVRDKPHVNVGTIGHVDHGKTTLTAAITKILAEGGGAKFKKYEEIDNAPEERARGITINAAHVEYSTAARHYAHTDCPGHADYVKNMITGTAPLDGCILVVAANDGPMPQTREHLLLARQIGVEHVVVYVNKADAVQDSENWGGGGKKPFGGLGKTGRSREPAHRVCAIKEEETPVIVGSALCALEGRDPELGLKSVQKLLDAVDTYIPVPARDLEKPFLLPVEAVYSVPGRGTVVTGTLERGILKKGDECELLGHSKNIRTVVTRH

SEQ ID NO: 1030280 - protein, 145 aa, Homo sapiens [sequence omitted]

SEQ ID NO: 1030281 - protein, 145 aa, Homo sapiens [sequence omitted]

SEQ ID NO: 1030282 - protein, 452 aa, Homo sapiens; identical to SEQ ID NO: 1030267

SEQ ID NO: 1030283 - protein, 452 aa, Homo sapiens; identical to SEQ ID NO: 1030267

SEQ ID NO: 1030284 - protein, 452 aa, Homo sapiens; identical to SEQ ID NO: 1030267

SEQ ID NO: 1030285 - protein, 197 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALNRKVHNFQMECSLQAKPAVPTSKLGQAEGRDAGSAPSGGDPAFLGMAVNTLCGEVPLYYI

SEQ ID NO: 1030286 - protein, 102 aa, Homo sapiens
MASMCVYYNEPTRTLRSMVLEMSIGAPEAQQRLALSEHLVTTATFSIGSTGLVVYDYQQLLIAYKPAPGTCCYIMKIAPESIPSLEHPVWRGAALLHLGRLR

SEQ ID NO: 1030287 - protein, 191 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFQAKPAVPTSKLGQAEGRDAGSAPSGGDPAFLGMAVSTLCGEVPLYYI

SEQ ID NO: 1030288 - protein, 143 aa, Homo sapiens
MGLHMSQKHTEMVLEMSIGAPEAQQRLALSEHLVTTATFSIGSTGLVVYDYQQLLIAYKPAPGTCCYIMKIAPESIPSLEALTRKVHNFFQMECSLQAKPAVPTSKLGQAEGRDAGSAPSGGDPAFLGMAVSTLCGEVPLYYI

SEQ ID NO: 1030289 - protein, 198 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFFQMECSLQAKPAVPTSKLGQAEGRDAGSAPSGGDPAFLGMAVSTLCGEVPLYYI

SEQ ID NO: 1030290 - protein, 230 aa, Homo sapiens
KEDEEQHSSVQREMDCVACNIGFLDWRRTDETLRPVSYAGGRILAFPAARWHLEASCIYIVDEWMVGYRNRSVSRISWRDALTAVGVYSSSCQAKTLEMVLEMSIGAPEAQQRLALSEHLVTTATFSIGSTGLVVYDYQQLLIAYKPAPGTCCYIMKIAPESIPSLEALTRKVHNFFQMECSLQAKPAVPTSKLGQAEGRDAGSAPSGGDPAFLGMAVSTLCGEVPLYYI

SEQ ID NO: 1030291 - protein, 151 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFFQVCVCG

SEQ ID NO: 1030292 - protein, 191 aa, Homo sapiens; identical to SEQ ID NO: 1030287

SEQ ID NO: 1030293 - protein, 108 aa, Homo sapiens
MRRGEHSTCSKMDVGSKEVLMESPPDYSAAPRGRFGIPCCPVHLKRLLIVVVVVVLIVVVIVGALLMGLHMSQKHTEMVLEMSIGAPEAQQRLASAPLASWCMTTSSC

SEQ ID NO: 1030294 - protein, 151 aa, Homo sapiens; identical to SEQ ID NO: 1030291

SEQ ID NO: 1030295 - protein, 150 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFSTAPLY

SEQ ID NO: 1030296 - protein, 103 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSAIEVWEPA

SEQ ID NO: 1030297 - protein, 285 aa, Homo sapiens
MDVGSKEVLMESPPDYSAAPRGRFGIPCCPVHLKRLLIVVVVVVLIVVVIVGAPTGKETPRAKGLLQLLQTGKKLLLPTPRVLMGLHMSQKHTEMVLEMSIGAPEAQQRLALSEHLVTTATFSIGSTGLVVYDYQQLLIAYKPAPGTCCYIMKIAPESIPSLEALTRKVHNFFQMECSLQAKPAVPTSKLGQAEGRDAGSAPSGGDPAFLGMAVSPCVARGGLIIRAPVSRSVETQGFRQTDKPVKQKRKKKLARAKLTLGGPKKWSPNGKGSTSGGKKCGNPTP

SEQ ID NO: 1030298 - protein, 198 aa, Homo sapiens; identical to SEQ ID NO: 1030289

SEQ ID NO: 1030299 - protein, 191 aa, Homo sapiens; identical to SEQ ID NO: 1030287

SEQ ID NO: 1030300 - protein, 168 aa, Homo sapiens
SARYLNLEVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFFQMECSLQAKPAVPTSKLGQAEGRDAGSAPSGGDPAFLGMAVSTLCGEVPLYYI

SEQ ID NO: 1030301 - protein, 145 aa, Homo sapiens
MDVGSKEVLMESPPVLEMSIGAPEAQQRLALSEHLVTTATFSIGSTGLVVYDYQQLLIAYKPAPGTCCYIMKIAPESIPSLEALTRKVHNFFQMECSLQAKPAVPTSKLGQAEGRDAGSAPSGGDPAFLGMAVSTLCGEVPLYYI

SEQ ID NO: 1030302 - protein, 132 aa, Homo sapiens
MVLEMSIGAPEAQQRLALSEHLVTTATFSIGSTGLVVYDYQQLLIAYKPAPGTCCYIMKIAPESIPSLEALTRKVHNFFQMECSLQAKPAVPTSKLGQAEGRDAGSAPSGGDPAFLGMAVSTLCGEVPLYYI

SEQ ID NO: 1030303 - protein, 150 aa, Homo sapiens; identical to SEQ ID NO: 1030295

SEQ ID NO: 1030304 - protein, 123 aa, Homo sapiens
YLHDVAAGRRGWLVGASECWESYTTFSIGSTGLVVYDYQQLLIAYKPAPGTCCYIMKIAPESIPSLEALTRKVHNFQAKPAVPTSKLGQAEGRDAGSAPSGGDPAFLGMAVSTLCGEVPLYYI

SEQ ID NO: 1030305 - protein, 239 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFQAKPAVPTSKPPCVARCRSTTSRTPPVSRVSGSPNGKGNAPGKGSFAAFADGQEAASAHTAGTSPGEMGAWGEDGSGQRWRPGARELLPQQNKAA

SEQ ID NO: 1030306 - protein, 82 aa, Homo sapiens
SSARLQLNTGSEAAFSPSFSAVIVQVHNFQMECSLQAKPAVPTSKLGQAEGRDAGSAPSGGDPAFLGMAVSTLCGEVPLYYI

SEQ ID NO: 1030307 - protein, 157 aa, Homo sapiens
MDVGSKEVLMESPPVLEMSIGAPEAQQRLALSEHLVTTATFSIGSTGLVVYDYQQLLIAYKPAPGTCCYIMKIAPESIPSLEALTRKVHNFVSGSPNGKGNAPGKGSFAAFADGQEAASAHTAGTSPGEMGAWGEDGSGQRWRPGARELLPQQNKAA

SEQ ID NO: 1030308 - protein, 253 aa, Homo sapiens [sequence omitted]

SEQ ID NO: 1030309 - protein, 113 aa, Homo sapiens
MLYFSLFWAARPLQRCGQLVRMAIRAQHSNAAQTQTGEANRGWTGQESLSDSDPEMWELLQRENGQAVSWPGAHCLRELLQPSCAGGPGVLSEQQVLGGLSWQEILWGSRGGG

SEQ ID NO: 1030310 - protein, 113 aa, Homo sapiens; identical to SEQ ID NO: 1030309

SEQ ID NO: 1030311 - protein, 253 aa, Homo sapiens [sequence omitted]

SEQ ID NO: 1030312 - protein, 504 aa, Homo sapiens
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 1030313 - protein, 504 aa, Homo sapiens; identical to SEQ ID NO: 1030312

SEQ ID NO: 1030314 - protein, 253 aa, Homo sapiens [sequence omitted]

SEQ ID NO: 1030315 - protein, 253 aa, Homo sapiens [sequence omitted]

SEQ ID NO: 1030316 - protein, 253 aa, Homo sapiens [sequence omitted]

SEQ ID NO: 1030317 - protein, 213 aa, Homo sapiens
MAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTGE

SEQ ID NO: 1030318 - protein, 219 aa, Homo sapiens
MAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 1030319 - protein, 254 aa, Homo sapiens
MAHISGLVAAKVIPSPFKHADIVTTTTHKTLRGARSGLIFYRKGVKAVDPKTGREIPYAQFEERIKFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 1030320 - protein, 259 aa, Homo sapiens
MAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLVLMSIEGTWEMRPTDSKLLSFPLPGPVK

SEQ ID NO: 1030321 - protein, 257 aa, Homo sapiens
MLASFDYARMREAYSWGTVGLDLRGIHSHLQPLRLLAQLSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 1030322 - protein, 253 aa, Homo sapiens [sequence omitted]

SEQ ID NO: 1030323 - protein, 229 aa, Homo sapiens
DASTSWVKSDEAELVAGPPATSELRCCTSLCFGRLGLCRDVGSWSGWPFGLSTATQPRLRLGKQTGAGQARRACRTVILRCGSCCRGRMDRQCRGLELIASENFCSRAALEALGSCLNNKYSEGYPGKRYYGGAEVVDDTLSCCASCLGLGKPFDHGSCTDGESNVQTLLQGPQPNLAVIHRPFLQTSRPDHGGLDLARWGAISPTAYIVLTVEADIKPRPSSSEVYAL

SEQ ID NO: 1030324 - protein, 294 aa, Homo sapiens
MPYKSSKPQNWPHLTTNQLALETDCRLFRHGHHSWHHSAYARLIDYARMREVCDEVKAHLLADMAHISGLVAAKVIPSPFKHADIVTTTTHKTLRGASYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 1030325 - protein, 229 aa, Homo sapiens; identical to SEQ ID NO: 1030323

SEQ ID NO: 1030326 - protein, 253 aa, Homo sapiens [sequence omitted]

SEQ ID NO: 1030327 - protein, 141 aa, Homo sapiens
MDRQCRGLELIASENFCSRAALEALGSCLNNKYSEGYPGKRYYGGAEVVDDTLSCCASCLGLGKPFDHGSCTDGESNVQTLLQGPQPNLAVIHRPFLQTSRPDHGGLDLARWGAISPTAYIVLTVEADIKPRPSSSEVYAL

SEQ ID NO: 1030328 - protein, 114 aa, Homo sapiens
PTPPEITRVGGWTSCDFRVAMLYFSLFWAARPLQRCGQLVRMAIRAQHSNAAQTQTGEANRGWTGQESLSDSDPEMWELLQRENGQAVSWPGAHCLRGGTWGDGQGLGHHGYRK

SEQ ID NO: 1030329 - protein, 253 aa, Homo sapiens [sequence omitted]

SEQ ID NO: 1030330 - protein, 253 aa, Homo sapiens [sequence omitted]

SEQ ID NO: 1030331 - protein, 253 aa, Homo sapiens [sequence omitted]

SEQ ID NO: 1030332 - protein, 159 aa, Homo sapiens [sequence omitted]

SEQ ID NO: 1030333 - protein, 238 aa, Homo sapiens
MAHISGLVAAKVIPSPFKHADIVTTTTHKTLRGASKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 1030334 - protein, 174 aa, Homo sapiens
MAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANEHLGDPSRSTAAASACP

SEQ ID NO: 1030335 - protein, 229 aa, Homo sapiens; identical to SEQ ID NO: 1030323

SEQ ID NO: 1030336 - protein, 253 aa, Homo sapiens [sequence omitted]

SEQ ID NO: 1030337 - protein, 144 aa, Homo sapiens [sequence omitted]

SEQ ID NO: 1030338 - protein, 229 aa, Homo sapiens; identical to SEQ ID NO: 1030323

SEQ ID NO: 1030339 - protein, 178 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFSVSVRDSREEPGGSSPRGAMLRAGLSSVTIPACNISVNSEMDLGPLTPRTQPWARARGGRRSAERARRK

SEQ ID NO: 1030340 - protein, 98 aa, Homo sapiens
QPYCPGPPVPAWEPVCALDSPACCRKIIQAVVPDPITWLYLRYKHNIHRGLVAFPEVGLDYNLHLYPHLHDLGPLTPRTQPWARARGGRRSAERARRK

SEQ ID NO: 1030341 - protein, 133 aa, Homo sapiens
ACGVGVASSCEDQLGPNSSRRGGRQALTTPGLLQLVVLAVEHTALALMEIKVCDGQEHVVTVSLRDGEATLEVDGTRGQSEVSAAQLQERLAVLERHLRSPVLTFAGGLQVGAPCFAHPGEELQGGPAWSPQI

SEQ ID NO: 1030342 - protein, 550 aa, Homo sapiens
VPPRQVALQGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 1030343 - protein, 658 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQETDVPVTSAPVTAFYRGCMTLEVNRRLLDLDEAAYKHSDITAHSCPPVEPAAA

SEQ ID NO: 1030344 - protein, 650 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLQVGAPCFAHPGEELQGGPAWSPQI

SEQ ID NO: 1030345 - protein, 429 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGARGGRRSAERARRK

SEQ ID NO: 1030346 - protein, 114 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLALFRVSGTSGECCYLQTPSLS

SEQ ID NO: 1030347 - protein, 86 aa, Homo sapiens
DGHRGKPLSAWPHVEEPPGSRLSRTETEKPAASRGAMLRAGLSSVTIPACNISVNSEMDLGPLTPRTQPWARARGGRRSAERARRK

SEQ ID NO: 1030348 - protein, 132 aa, Homo sapiens
MSLLACSLLRSQGLCTLGLPFRPVLFPDVNECSQENGGCLQICHNKPGSFHCSCHSGFELSSDGRTLRVVVSNRGVIPRRDSVEASPATAASLWLADVDECLQGRCEQVCVNSPGSYTCHCDGRGGLKLSHR

SEQ ID NO: 1030349 - protein, 337 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRSLLRSWRGIWSSRSTGMLS

SEQ ID NO: 1030350 - protein, 340 aa, Homo sapiens
ARYPVDRNALALRAARLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 1030351 - protein, 634 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLLDLDEAAYKHSDITAHSCPPVEPAAA

SEQ ID NO: 1030352 - protein, 634 aa, Homo sapiens; identical to SEQ ID NO: 1030351

SEQ ID NO: 1030353 - protein, 560 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQVGPPPPRAS

SEQ ID NO: 1030354 - protein, 378 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRYHAALRYRARFD

SEQ ID NO: 1030355 - protein, 678 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 1030356 - protein, 678 aa, Homo sapiens; identical to SEQ ID NO: 1030355

SEQ ID NO: 1030357 - protein, 678 aa, Homo sapiens; identical to SEQ ID NO: 1030355

SEQ ID NO: 1030358 - protein, 614 aa, Homo sapiens
GRVGRHAVRLLRRASLCWAETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 1030359 - protein, 678 aa, Homo sapiens; identical to SEQ ID NO: 1030355

SEQ ID NO: 1030360 - protein, 634 aa, Homo sapiens; identical to SEQ ID NO: 1030351

SEQ ID NO: 1030361 - protein, 114 aa, Homo sapiens; identical to SEQ ID NO: 1030346

SEQ ID NO: 1030362 - protein, 105 aa, Homo sapiens
RGLERRSEMTKGTSSFGKRRNKTHTLCRRCGSKAYHLQKSTCGKCGYPAKRKRKYNWSAKAKRRNTTGTGRMRHLKIVYRRFRHGFREGTTPKPKRAAVAASSSS

SEQ ID NO: 1030363 - protein, 192 aa, Homo sapiens [sequence omitted]

SEQ ID NO: 1030364 - protein, 173 aa, Homo sapiens
LFFFAASTARMKTILSNQTVDIPENVDITLKGRTVIVKGPRGTLRRDFNHINVELSLLGKKKKRLRVLTNVGGLHRKRTRGSPVCGTICGSSCVTEHQCTQRGVYPVGLLAVHREVKRSWCYWPHFSPKSKRVCLLPRREKWRLLCGVRSRRKFLCGGVTQNLTSREEGGLGM

SEQ ID NO: 1030365 - protein, 247 aa, Homo sapiens
MKTILSNQTVDIPENVDITLKGRTVIVKGPRGTLRRDFNHINVELSLLGKKKKRLRVDKWWGNRKELATVRTICSHVQNMIKGVTLGFRYKMRSVYAHFPINVVIQENGSLVDKWWGNRKELATVRTICSHVQNMIKGVTLGFRYKMRSVYAHFPINVVIQENGSLVEIRNFLGEKYIRRVRMRPGVACSVSQAQKDELILEGNDIELVSNSAALIQQATTVKNKDIRKFLDGIYVSEKGTVQQADE

SEQ ID NO: 1030366 - protein, 434 aa, Homo sapiens
CLHQSSGTLLSVPATLQPRPHFSWSPFQAPRNHHQTHQFHSVTPQSLSCLHPSLRDSPVCPSYSPTTPTFQRESVPGTQESPPNSPISLSYSPVSLMSSPPAPWDSPVCPSYSPTTPRFQRESASHTPESPTDSQTSLRSSLVSLRSLPSAHRDSCVSFSYSQNFSRFQLESVPGTHDTPPNSRISLTYSPVSLMFSPPALRDSSVSLSYSPTISRFHLESASRTQESPTNSRTLLQPSPISFTSSPPAFRDSPGSPSFSPAFPRFLPQSAPGTQDNPRHSQASRDYLPMTCTYTGIAPTHPSVTPNPSPLTLRHSQGLTATPRYCPSVRSPGQSTSPHDAVTWPFLHSSREGPTPSRTRAPPAFRPHTQACPSTCYCHTLASRRGPCNGRYHHPVYPHPTAVQREPPAGPRARHSPCWHDAPAGRRPCGPHYR

SEQ ID NO: 1030367 - protein, 484 aa, Homo sapiens
CLHQSSGTLLSVPATLQPRPHFSWSPFQAPRNHHQTHQFHSVTPQSLARLDLQPSGTRLSVLSYSPHIAQHCKRAARADTLPSRLTHRFHCVTPQSLSCLHPSLRDSPVCPSYSPTTPTFQRESVPGTQESPPNSPISLSYSPVSLMSSPPAPWDSPVCPSYSPTTPRFQRESASHTPESPTDSQTSLRSSLVSLRSLPSAHRDSCVSFSYSQNFSRFQLESVPGTHDTPPNSRISLTYSPVSLMFSPPALRDSSVSLSYSPTISRFHLESASRTQESPTNSRTLLQPSPISFTSSPPAFRDSPGSPSFSPAFPRFLPQSAPGTQDNPRHSQASRDYLPMTCTYTGIAPTHPSVTPNPSPLTLRHSQGLTATPRYCPSVRSPGQSTSPHDAVTWPFLHSSREGPTPSRTRAPPAFRPHTQACPSTCYCHTLASRRGPCNGRYHHPVYPHPTAVQREPPAGPRARHSPCWHDAPAGRRPCGPHYR

SEQ ID NO: 1030368 - protein, 235 aa, Homo sapiens
MSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLTSAQDVRI

SEQ ID NO: 1030369 - protein, 303 aa, Homo sapiens
SVGLEVWGRTGQLLMRTSVSFPGTRGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLTSAQDVRI

SEQ ID NO: 1030370 - protein, 319 aa, Homo sapiens
MTRMVTMVCRIWDWLQERYEIVGNLGEGTFGKVVECLDHARGKSQVALKIIRNVGKYREAARLEINVLKKIKEKDKENKFLCVLMSDWFNFHGHMCIAFELLGKNTFEFLKENNFQPYPLPHVRHMAYQLCHALRFLHENQLTHTDLKPENILFVNSEFETLYNEHKSCEEKSVKNTSIRVADFGSATFDHEHHTTIVATRHYRPPEVILELGWAQPCDVWSIGCILFEYYRGFTLFQTHENREHLVMMEKILGPIPSHMIHRTRKQKYFYKGGLVWDENSSDGRYVKENCKPLKSYMLQDSLEHVQLFDLTSAQDVRI

SEQ ID NO: 1030371 - protein, 87 aa, Homo sapiens
FGSFAAAVFATMPPYTVVYFPVRGRCAALRMLLADQGQSWKEEVVTVETWQEGSLKASCLYGQLPKFQDGDLTLYQSNTIPPYYQKT

SEQ ID NO: 1030372 - protein, 234 aa, Homo sapiens
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYVSLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGETVRVGGTLSGRQSLPSFLPGSNKGF

SEQ ID NO: 1030373 - protein, 131 aa, Homo sapiens
MLSLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGKTVRVGGTLSGRQSLPSFLPGSNKGF

SEQ ID NO: 1030374 - protein, 263 aa, Homo sapiens
MPPYTVVYFPVRGRCAAFNQGAKVLRMLLADQGQSWKEEVVTVDSKGWNRKETWQEGSLKASCLYGQLPKFQDGDLTLYQSNTILRHLGRTLGLYGKDQQEAALVDMVNDGVVREKIKSEDLRCKYISLIYTNYEAGKDDYVKALPGQLKPFETLLSQNQGGKTFIVGDQISFADYNLLDLLLIHEVLAPGCLDAFPLLSAYVGRLSARPKLKAFLASPNRERKSPEYVNLPINGNGKTVRVGGTLSGRQSLPSFLPGSNKGF

SEQ ID NO: 1030375 - protein, 348 aa, Homo sapiens
QPVSLQAPGEVTRAISAPTTSTTSGPGTTPSPVPTTSTTSAPTTRTTSAPKSSTTSAATTSTTSGPETTPRPVPATTPSLFSYNQLNLCSYNQHNLCFYNQHNLWSWNYSQPCSHHQHNLCSYNQHNLCPYNQHNLCHYNQHNLCSYNYSQPCSYNQHNLCSYNQHNLWSWNYSQCCSHHQHNLCTYNQYKLCPYKQHNLCHYNQRISGPETTPSPVPTASTTSASTTSTTSGPGTTPSPVPTTSTISVPTTSSNFCFYNQHNLCFYNQHNFWSWNYPKPCSHHQHNLCSYNQHNLCRYNQHNLGPNNQHNVCSYNQHNLCLYSQQNLWSWNYSQPYSYHQHNLSSYK

SEQ ID NO: 1030376 - protein, 268 aa, Homo sapiens
QPVSLQAPGEVTRAISAPTTSTTSGPGTTPSPVPTTSTTSAPTTRTTSAPKSSTTSAATTSTTSGPETTPRPVPATTPSLFSYNQLNLCSYNQHNLCFYNQHNLWSWNYSQPCSHHQHNLCSYNQHNLCPYNQHNLCHYNQHNLCSYNYSQPCSYNQHNLCSYNQHNLYPYKQHNLHSTDQHNLCFYNQHNFWSWNYPKPCSHHQHNLCSYNQHNLCRYNQHNLGPNNQHNVCSYNQHNLCLYSQQNLWSWNYSQPYSYHQHNLSSYK

SEQ ID NO: 1030377 - protein, 123 aa, Homo sapiens
KSPRDNWLVAPKPCFPLTSTNSGPKTRKKLFGSYEDQHNLCFYNQHNFWSWNYPKPCSHHQHNLCSYNQHNLCRYNQHNLGPNNQHNVCSYNQHNLCLYSQQNLWSWNYSQPYSYHQHNLSSY

SEQ ID NO: 1030378 - protein, 196 aa, Homo sapiens
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 1030379 - protein, 211 aa, Homo sapiens [sequence omitted]

SEQ ID NO: 1030380 - protein, 211 aa, Homo sapiens [sequence omitted]

SEQ ID NO: 1030381 - protein, 211 aa, Homo sapiens [sequence omitted]

SEQ ID NO: 1030382 - protein, 98 aa, Homo sapiens
LWVQASRQMHNRLRRYLSYEDTLLLEDQPTGENEMVIMRPGNKYEYKFGFELPQGPLGPSSKEIWVCSYLVKAFLTPEPANLRDKKTLSSGSGGCQYP

SEQ ID NO: 1030383 - protein, 218 aa, Homo sapiens
MSTGSVSDPEEMELRGLQREYPVPASKRPPLRGVERSYASPSDNSSAEEEDPDGEEERCALGTAGSAEGCKRKRPRVAGGGGAGGSAGGGGKKPLPAKGSAAECKQSQRNAANARERARMRVLSKAFSRLKTSLPWVPPDTKLSKLDTLRLASSYIAHLRQLLQEDRYENGYVHPVNLTWPFVVSGRPASAPKKFPQPTDYVEPPLKSDWNSLDGIIR

SEQ ID NO: 1030384 - protein, 219 aa, Homo sapiens
MSTGSVSDPEEMELRGMLILCVDVMLLWVLQREYPVPASKRPPLRGVERSYASPSDNSSAEEEDPDGEEERCALGTAGSAEGCKRKRPRVAGGGGAGGSAGGGGKKPLPAKGSAAECKQSQRNAANARERARMRVLSKAFSRLKTSLPWVPPDTKLSKLDTLRLASSYIAHLRQLLQEDRYENGYVHPVNLTWPFVVSGRPDSDTKEVSAANRLCGTTA

SEQ ID NO: 1030385 - protein, 166 aa, Homo sapiens
MSTGSVSDPEEMELRGLQREYPVPASKRPPLRGVERSYASPSDNSSAEEEDPDGEEERCALGTAGSAEGCKRKRPRVAGGGGAGGSAGGGGKKPLPAKGSAAECKQSQRNAANARERARMRVLSSDSRLSASGLPTPRSGRPNSNTTSCRAGSSPRGGARRVGGLP

SEQ ID NO: 1030386 - protein, 229 aa, Homo sapiens
GKRERLASGEERARLSGDTGFTGSVITGSVSDRGMSFVGLQREYPVPASKRPPLRGVERSYASPSDNSSAEEEDPDGEEERCALGTAGSAEGCKRKRPRVAGGGGAGGSAGGGGKKPLPAKGSAAECKQSQRNAANARERARMRVLSKAFSRLKTSLPWVPPDTKLSKLDTLRLASSYIAHLRQLLQEDRYENGYVHPVNLTWPFVVSGRPDSDTKEVSAANRLCGTTA

SEQ ID NO: 1030387 - protein, 173 aa, Homo sapiens
MSTGSVSDPEEMELRGACDDGQMITGNRRSTEERDSIGGKKQRSYASPSDNSSAEEEDPDGEEERCALGTAGSAEGCKRKRPRVAGGGGAGGSAGGGGKKPLPAKGSAAECKQSQRNAANARERARMRVLSSDSRLSASGLPTPRSGRPNSNTTSCRAGSSPRGGARRVGGLP

SEQ ID NO: 1030388 - protein, 218 aa, Homo sapiens; identical to SEQ ID NO: 1030383

SEQ ID NO: 1030389 - protein, 299 aa, Homo sapiens
GWVTVSPVGGNSWIYSGALLVTKGHIMCPKISVSLPEKLAEVNVRSRKLSTQSLPNKGSQTLCFGLVPALTGGTYLDMPDPPLDRNYVGLAAESVSRISTRKDIASFPQSLWSQICTCTLTYWHMEVCVNMPLRDFFFFFLEALEYSFIPTRLDPLPRGSGPTVLTWRSLSCAAASFVNIQQLLDERPPEGLKSYAGAGLQERTDRPVPVLEEPMIRAETGVLRRLTRSLKYNCGEPHKMDARWSAVNDQADLVCDPRRARVDQAKGTEDWDLEVGWRRLDHWRKGIALCVMSIERRYG

SEQ ID NO: 1030390 - protein, 97 aa, Homo sapiens
SGSIWVTTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030391 - protein, 105 aa, Homo sapiens
QRISGRRYRGFPAVTTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030392 - protein, 99 aa, Homo sapiens
DAWVDPRVRTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030393 - protein, 98 aa, Homo sapiens
PQDLGKRQPYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030394 - protein, 105 aa, Homo sapiens; identical to SEQ ID NO: 1030391

SEQ ID NO: 1030395 - protein, 101 aa, Homo sapiens
VNLEDPPGNETTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030396 - protein, 105 aa, Homo sapiens; identical to SEQ ID NO: 1030391

SEQ ID NO: 1030397 - protein, 105 aa, Homo sapiens; identical to SEQ ID NO: 1030391

SEQ ID NO: 1030398 - protein, 90 aa, Homo sapiens
RPATTNAHLIIPRAKQPPALFLKRKHTPTPLQSPNSYFMDVKCPGCYKITTVFSHAQTVVLCVGCSTVLCQPTGGKARLTEGCSFRRKQH

SEQ ID NO: 1030399 - protein, 84 aa, Homo sapiens
MPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030400 - protein, 80 aa, Homo sapiens
HSARYPLSRVEKRKHKKKRLVQSPNSYFMDVKCPGCYKITTVFSHAQTVVLCVGCSTVLCQPTGGKARLTEGCSFRRKQH

SEQ ID NO: 1030401 - protein, 84 aa, Homo sapiens; identical to SEQ ID NO: 1030399

SEQ ID NO: 1030402 - protein, 84 aa, Homo sapiens; identical to SEQ ID NO: 1030399

SEQ ID NO: 1030403 - protein, 84 aa, Homo sapiens; identical to SEQ ID NO: 1030399

SEQ ID NO: 1030404 - protein, 84 aa, Homo sapiens; identical to SEQ ID NO: 1030399

SEQ ID NO: 1030405 - protein, 84 aa, Homo sapiens; identical to SEQ ID NO: 1030399

SEQ ID NO: 1030406 - protein, 129 aa, Homo sapiens
MCRSQRMCRSQRMCRSQRMCRSQRMCRSQACAGAFPAVTTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030407 - protein, 67 aa, Homo sapiens
IRGRVDTVREDDRRGLSGGDDLRTREHASRKGSPSSLSRRGEEETQEETPGAEPQFLLHGCEMPRML

SEQ ID NO: 1030408 - protein, 101 aa, Homo sapiens; identical to SEQ ID NO: 1030395

SEQ ID NO: 1030409 - protein, 136 aa, Homo sapiens
TKRLHGSRGNQMEHLSQAGLFLAMAKFQEVPKAKYIWKVLPNWRTQCRAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030410 - protein, 101 aa, Homo sapiens
FAAASTRCEKTTEAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030411 - protein, 99 aa, Homo sapiens; identical to SEQ ID NO: 1030392

SEQ ID NO: 1030412 - protein, 98 aa, Homo sapiens; identical to SEQ ID NO: 1030393

SEQ ID NO: 1030413 - protein, 80 aa, Homo sapiens; identical to SEQ ID NO: 1030400

SEQ ID NO: 1030414 - protein, 121 aa, Homo sapiens
LEIHGDEQRRPNQEEVFVLVIVGQVFQLLLAVYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 1030415 - protein, 129 aa, Homo sapiens; identical to SEQ ID NO: 1030406

SEQ ID NO: 1030416 - protein, 129 aa, Homo sapiens; identical to SEQ ID NO: 1030406

SEQ ID NO: 1030417 - protein, 118 aa, Homo sapiens
IRGRVDTVREDDEGAFPAVTTYAHENMPLAKDLLHPSPEEEKRKHKKKRLVQSPNSYFMDVKCPGCYKITTVFSHAQTVVLCVGCSTVLCQPTGGKARLTEGCSFRRERHMEFYKDLR

SEQ ID NO: 1030418 - protein, 84 aa, Homo sapiens; identical to SEQ ID NO: 1030399

SEQ ID NO: 1030419 - protein, 84 aa, Homo sapiens; identical to SEQ ID NO: 1030399

SEQ ID NO: 1030420 - protein, 84 aa, Homo sapiens; identical to SEQ ID NO: 1030399

SEQ ID NO: 1030421 - protein, 84 aa, Homo sapiens; identical to SEQ ID NO: 1030399

SEQ ID NO: 1030422 - protein, 84 aa, Homo sapiens; identical to SEQ ID NO: 1030399

SEQ ID NO: 1030423 - protein, 84 aa, Homo sapiens; identical to SEQ ID NO: 1030399

SEQ ID NO: 1030424 - protein, 84 aa, Homo sapiens; identical to SEQ ID NO: 1030399

SEQ ID NO: 1030425 - protein, 84 aa, Homo sapiens; identical to SEQ ID NO: 1030399

SEQ ID NO: 1030426 - protein, 84 aa, Homo sapiens; identical to SEQ ID NO: 1030399

SEQ ID NO: 1030427 - protein, 84 aa, Homo sapiens; identical to SEQ ID NO: 1030399

SEQ ID NO: 1030428 - protein, 84 aa, Homo sapiens; identical to SEQ ID NO: 1030399

SEQ ID NO: 1030429 - protein, 84 aa, Homo sapiens; identical to SEQ ID NO: 1030399

SEQ ID NO: 1030430 - protein, 84 aa, Homo sapiens; identical to SEQ ID NO: 1030399

SEQ ID NO: 1030431 - protein, 84 aa, Homo sapiens; identical to SEQ ID NO: 1030399

SEQ ID NO: 1030432 - protein, 84 aa, Homo sapiens; identical to SEQ ID NO: 1030399

SEQ ID NO: 1030433 - protein, 84 aa, Homo sapiens; identical to SEQ ID NO: 1030399

SEQ ID NO: 1030434 - protein, 84 aa, Homo sapiens; identical to SEQ ID NO: 1030399

SEQ ID NO: 1030435 - protein, 129 aa, Homo sapiens; identical to SEQ ID NO: 1030406

SEQ ID NO: 1030436 - protein, 120 aa, Homo sapiens
IRGRVDTVREDDEGAFPAVTTYAHENMPLAKDLLHPSPEEEKRKHKKKRLVQSPNSYFMDVKCPGCYKITTVFSHAQTVVLCVGCSTVLCQPTGGKARLTEGCSWDESPRHEGILKKRRS

SEQ ID NO: 1030437 - protein, 629 aa, Homo sapiens
MTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTALCSPGVLQTVKWFLEFRCIFSLAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRAFMWFSDITKHKQTHTGEKPYKCDECGKNFTQSSNLIVHKRIHTGEKPYKCEKCGKAFTQFSHLTVHESIHT

SEQ ID NO: 1030438 - protein, 1130 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDAFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLRQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 1030439 - protein, 932 aa, Homo sapiens [sequence omitted]

SEQ ID NO: 1030440 - protein, 884 aa, Homo sapiens [sequence omitted]

SEQ ID NO: 1030441 - protein, 527 aa, Homo sapiens
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPGREVPRKTQLGSSLLLRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 1030442 - protein, 1130 aa, Homo sapiens; identical to SEQ ID NO: 1030438

SEQ ID NO: 1030443 - protein, 932 aa, Homo sapiens [sequence omitted]

SEQ ID NO: 1030444 - protein, 932 aa, Homo sapiens [sequence omitted]

SEQ ID NO: 1030445 - protein, 3259 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 1030446 - protein, 3295 aa, Homo sapiens
SVPGVYRCHVAYGLPELTWLELGGGQLEPQAAALLEMLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 1030447 - protein, 3240 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQGFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 1030448 - protein, 3259 aa, Homo sapiens; identical to SEQ ID NO: 1030445

SEQ ID NO: 1030449 - protein, 3262 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTATGSQY

SEQ ID NO: 1030450 - protein, 2976 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQFQWNSLPIYRSSLQLFTESACKNRGGYEDRLELQGLASLLSSTALSLNASA

SEQ ID NO: 1030451 - protein, 152 aa, Homo sapiens [sequence omitted]

SEQ ID NO: 1030452 - protein, 2737 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 1030453 - protein, 3129 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQGKRMEFTERVTLRN

SEQ ID NO: 1030454 - protein, 2509 aa, Homo sapiens
SPHQGDPPPPGRNLLLLRLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 1030455 - protein, 3180 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRR

SEQ ID NO: 1030456 - protein, 2896 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLSS

SEQ ID NO: 1030457 - protein, 277 aa, Homo sapiens
NQADSSHQVQTPKTGWQAHMKEDQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 1030458 - protein, 2309 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKKKKKKKKKKKKKKKKKKKKKRKKKKIQTKREKHKKKKHTRTSRRHSRKAPQSRAQYKTEAPPPHKTTNPSRDVKQYPEQPRPKHHTTGRGNHTATHLNPKTTTPTRGPHNRQETPTGHTTPTRKPPKPTGPTRTPTPENTLHTQNTPNAPTRNHHHTQARNLNNTPRPTNTPAPPPHTAHTHNNPATQPPSTTRRGQPRGRGEAKEPAKTPTRKRTGTHARPASQAKRATTERNRHSTTTHTPPHDTNSGPESENAATTKRRRDPARGRPDQTANKSESKEAQSRRTREQDETNRPTERERNAKETHIDSKAEPTT

SEQ ID NO: 1030459 - protein, 116 aa, Homo sapiens [sequence omitted]

SEQ ID NO: 1030460 - protein, 3225 aa, Homo sapiens [sequence omitted]

SEQ ID NO: 1030461 - protein, 3259 aa, Homo sapiens; identical to SEQ ID NO: 1030445

SEQ ID NO: 1030462 - protein, 3117 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAWRQGFTILARLVLNS

SEQ ID NO: 1030463 - protein, 3259 aa, Homo sapiens; identical to SEQ ID NO: 1030445

SEQ ID NO: 1030464 - protein, 2949 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQVFSPTLHGKCLQKQRWIRGQVGAAGTGESAFFYCPEPERFCLI

SEQ ID NO: 1030465 - protein, 264 aa, Homo sapiens
VLVGLKRPEDQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 1030466 - protein, 2730 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKELLSQLEETRHLYHSSQNELAKLESELKSLKDQLTDLSNSLEKCKEQKGNLEGIIRQQEADIQNSKFSYDTGDWSSAQELTSRLHEERVLAVR

SEQ ID NO: 1030467 - protein, 2208 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKKKKKKKKKQKKKKKKTKNKKKGGPPFSPAGGPKTARPPRCLSMSTQRPPSQTGAKQAPQKTRRRALNTRQRRERGNTAARGPRSAHATALPRGAGATTGDDTTTSNSTHTQRLGANQKTGTTEPQPVGRSTRGHHEPAAAELKKTDAPTRRTLPRRRNQPLIPPAAPSAHTDRADSPPPTTTDRRPQLETPSTHRSARRRTAHAATPQHGVASEG

SEQ ID NO: 1030468 - protein, 483 aa, Homo sapiens
TKDPVDRPTLTRDNARGHWTTVAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 1030469 - protein, 832 aa, Homo sapiens
GSAPRAATAMARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLVQEAGGRETGGGAYQPGARAWGAGRSH

SEQ ID NO: 1030470 - protein, 1002 aa, Homo sapiens
GSAPRAATAMARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQEWGNVTPPS

SEQ ID NO: 1030471 - protein, 998 aa, Homo sapiens [sequence omitted]

SEQ ID NO: 1030472 - protein, 115 aa, Homo sapiens
SRVSHSIAVSILSPAFKVREFSITDVVPYPISLRWNSPAEEGSSDCEVFSKNHAAPFSKVLTFYRKEPFTLEAYYSSPQDLPYPDPAIAQFSVQKVTPQSDAHRNMMVPSSITAC

SEQ ID NO: 1030473 - protein, 840 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVREYVYEMRDKLSGEYEKFVSEDGRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030474 - protein, 474 aa, Homo sapiens [sequence omitted]

SEQ ID NO: 1030475 - protein, 758 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030476 - protein, 620 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030477 - protein, 474 aa, Homo sapiens [sequence omitted]

SEQ ID NO: 1030478 - protein, 227 aa, Homo sapiens
MMDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030479 - protein, 225 aa, Homo sapiens
MSKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030480 - protein, 148 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEEQNGPVDGQGDNPGPQAAEQGTDTAVPSDSDKKLPEMDID

SEQ ID NO: 1030481 - protein, 588 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEEMETSQAGSKDKKMDQPPQAKKAKVKTSTVDLPIENQLLWQIDREMLNLYIENEGKMIMQDKLEKERNDAKNAVQEYVCDYLKG

SEQ ID NO: 1030482 - protein, 600 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWIQDKKMDQPPQAKKAKVKTSTVDLPIENQLLWQIDREMLNLYIENEGKMIMQDKLEKERNDAKNAVQEYVCDYLKG

SEQ ID NO: 1030483 - protein, 360 aa, Homo sapiens
RLLRSPMLPPQSDGSSSKVKVKVRVNVHGIFRCQCIFSGGHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWIQGKKMDQPPQAKKAKVKTSTVDLPIENQLLWQIDREMLNLYIENEGKMIMQDKLEKERNDAKNAVQEYVCDYLKG

SEQ ID NO: 1030484 - protein, 987 aa, Homo sapiens
RLLRSPMLPPQSDGSSSKVKVKVRVNVHGIFRCQCIFSGGHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEEEKTSAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030485 - protein, 469 aa, Homo sapiens
SRVSHSIAVSILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030486 - protein, 380 aa, Homo sapiens
RLLRSPMLPPQSDGSSSKVKVKVRVNVHGIFRCQCIFSGGHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030487 - protein, 149 aa, Homo sapiens
EKWQKLDSIAWEGGYHTFSTCLTVSWLQEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 1030488 - protein, 486 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDAHRNMMVPSSITAC

SEQ ID NO: 1030489 - protein, 474 aa, Homo sapiens [sequence omitted]

SEQ ID NO: 1030490 - protein, 840 aa, Homo sapiens; identical to SEQ ID NO: 1030473

SEQ ID NO: 1030491 - protein, 840 aa, Homo sapiens; identical to SEQ ID NO: 1030473

SEQ ID NO: 1030492 - protein, 474 aa, Homo sapiens [sequence omitted]

SEQ ID NO: 1030493 - protein, 107 aa, Homo sapiens
MFMPLPLKELFMPLPLKELFMPLPLKELFMPLPLKELFMPLPLKELFMPLPLKELFMPLPLKELFMPLPLKELFMPLPLKERCRARLKELFMPLPKRSCSCHCHIRV

SEQ ID NO: 1030494 - protein, 94 aa, Homo sapiens
GSGMNMAQLGLEKAPGRQEQGLQEAVLKSKLSHVHATAIKGAVHATAIKGAVHATAIKGAVHATAIKGAVPSSIKGAVHATAKKELFMPLPYKS

SEQ ID NO: 1030495 - protein, 109 aa, Homo sapiens
SSFNGSGMNITAPLMAGDFLEHGSQSLVSHVHATAIKGAVHATAIKGAVHATAIKGAVHATAIKGAVHATAIKGAVHATAIKGAVPSSIKGAVHATAKKELFMPLPYKS

SEQ ID NO: 1030496 - protein, 82 aa, Homo sapiens
FFVWAANMPSRLRKTRKLRGHVSHGHGRIGKHRKHPGGRGNAGGLHHHRINFDKYHPGYLWESGMKHYHLKRNQSFCPNCQP

SEQ ID NO: 1030497 - protein, 78 aa, Homo sapiens
MPSRLRKTRKLRGHVSHVHATAIKGAVHATAIKGAVHATAIKGAVHATAIKGAVPSSIKGAVHATAKKELFMPLPYKS

SEQ ID NO: 1030498 - protein, 123 aa, Homo sapiens
SSAQLFNGRCLYSSYLGGWGRRIACTQEVEVAVSHVHATAIKGAVHATAIKGAVHATAIKGAVHATAIKGAVHATAIKGAVHATAIKGAVHATAIKGAVPSSIKGAVHATAKKELFMPLPYKS

SEQ ID NO: 1030499 - protein, 333 aa, Homo sapiens
AERHMARSEAGGESAEASVWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGTKRLPMVTCCTLVSEDSFRSLGKSAKNEDDPGYFYDSSEMGTGIVVRYTVNTGEKRNKGEKAEEDRSAKIGEFGPKLLRKRATPLKSL

SEQ ID NO: 1030500 - protein, 389 aa, Homo sapiens
MLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 1030501 - protein, 526 aa, Homo sapiens
PPRPSGAAALVPRDLWGPGRRRPRPSQRTGRGGNREVPGGVHGGVPGGLRKAPAEAPALRLSRAAAAASLGRAQAQPMGRVGGMAQPMGRAGAPKPMGRAGSARRGRFKGCWSEGSPVHPVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 1030502 - protein, 398 aa, Homo sapiens
PPRPSGAAALVPRDLWGPGRRRPRPSQRTGRGGNREVPGGVHGGVPGGLRKAPAEAPALRLSRAAAAASLGRAQAQPMGRVGGMAQPMGRAGAPKPMGRAGSARRGRFKGCWSEGSPVHPVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNEL

SEQ ID NO: 1030503 - protein, 411 aa, Homo sapiens
PPRPSGAAALVPRDLWGPGRRRPRPSQRTGRGGNREVPGGVHGGVPGGLRKAPAEAPALRLSRAAAAASLGRAQAQPMGRVGGMAQPMGRAGAPKPMGRAGSARRGRFKGCWSEGSPVHPVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEVSLSQIIG

SEQ ID NO: 1030504 - protein, 414 aa, Homo sapiens
GRVGDDAWVTNPSCWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 1030505 - protein, 382 aa, Homo sapiens
LLCCDPRSATGQPRFHIGPREIAANGKDLVQKNVSFIWFARYLNVLFSPPKKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 1030506 - protein, 222 aa, Homo sapiens [sequence omitted]

SEQ ID NO: 1030507 - protein, 429 aa, Homo sapiens
PPRPSGAAALVPRDLWGPGRRRPRPSQRTGRGGNREVPGGVHGGVPGGLRKAPAEAPALRLSRAAAAASLGRAQAQPMGRVGGMAQPMGRAGAPKPMGRAGSARRGRFKGCWSEGSPVHPVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGTKRLPMVTCCTLAAVEAFFPALRADLPRTGTVLAPIYDFCRTGPGFAPRPPVQPGERKHRGKSPRARGPTHLATAPR

SEQ ID NO: 1030508 - protein, 312 aa, Homo sapiens
PPRPSGAAALVPRDLWGPGRRRPRPSQRTGRGGNREVPGGVHGGVPGGLRKAPAEAPALRLSRAAAAASLGRAQAQPMGRVGGMAQPMGRAGAPKPMGRAGSARRGRFKGCWSEGSPVHPVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVSFQNIFHSFDVDDLRSNKFAFLVLYVFPC

SEQ ID NO: 1030509 - protein, 330 aa, Homo sapiens
MVEAGWLNRHRGARAPVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGTKRLPMVNVLYPCCRGGFLSGLARSSAQNEDCAGPHFMTFAAQVPGVRRVPRSNPGRGNTGGKAPGPGGLHTWPRRPGRLGA

SEQ ID NO: 1030510 - protein, 422 aa, Homo sapiens
MVEAGWLNRHRGARAPVPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 1030511 - protein, 418 aa, Homo sapiens
QDSLGQACVNQERPAVLSWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 1030512 - protein, 419 aa, Homo sapiens
AERHMARSEAGGESAEASVWLLALLRCAATMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 1030513 - protein, 297 aa, Homo sapiens
MYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 1030514 - protein, 74 aa, Homo sapiens
GRVGDGRVGHPPVRTRGGSYKLFILVLFGVSRLCELIHLYLLCLLNQKFFIIYVLLDFTCSSYFSHPVSYSGIV

SEQ ID NO: 1030515 - protein, 389 aa, Homo sapiens; identical to SEQ ID NO: 1030500

SEQ ID NO: 1030516 - protein, 333 aa, Homo sapiens
MAPKKAKKRAGGANSNVFSMFEQTQIQEFKEAFTIMDQNRDGFIDKNDLRDTFAALGQSESDTMHRTLDCKLITEAPGSNEPLPVILTNVREEHNLHGHAEPLSETILNAFKVSDPERQRGADRLTHAPGNADHAAPERSPRTERLTQIVRRHSPPDVTWQPCALPRTLVHIITHGEDTDYGGGFACLRPGAPSLPEWFPGLISSPPKYPLLSYLVCTPCGCPFIHSIFFAAWPPSALDGRTSKGGIPPEGMFNKRTPRNNTTNTHHPPPTHTHNNNNEHPSHTPTAPTKPSPPAVPTLLQNAAAHSPPEPTRLTRRTNQLNRHAPHTAPHHQ

SEQ ID NO: 1030517 - protein, 104 aa, Homo sapiens
LLPRLECSGGISAHCNLRLPGSRPVSASVAGITGMHHHARLTFVFLVETGFHHDGQAGLELLTSSDPPALASQSAGITGVHPHPAPNSSCLHTDKRVHTWHKPS

SEQ ID NO: 1030518 - protein, 111 aa, Homo sapiens
LESTRIKDFDANSKIKDFPEKAKDFFIEATPFLNNSDHDRLHTLVTEHCFPDMTWDIKYKTVRWSFVESLEPSHVVQVRCSSMMNQATCTARSPYACTPGRLWPSMTGLAG

SEQ ID NO: 1030519 - protein, 111 aa, Homo sapiens; identical to SEQ ID NO: 1030518

SEQ ID NO: 1030520 - protein, 135 aa, Homo sapiens
MSETMRGESPKGRRGPEKCGAEIVACQLRDIALRPDLRLAVSRHRIKFAGLVDEIVPCQSVIAARRGHDKSGELRQLWQSVQHGTAAVIDRIRRIAVQIAQRIVGKRRQMNDGIEPGKISGFEVADVFPEGGNWN

SEQ ID NO: 1030521 - protein, 216 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 1030522 - protein, 178 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDIKDRKVKAKSIVFHRKKNLQYYDISAKSNYTVSLLCRSHETYWIVPAVRHCPL

SEQ ID NO: 1030523 - protein, 364 aa, Homo sapiens; identical to SEQ ID NO: 917033

SEQ ID NO: 1030524 - protein, 364 aa, Homo sapiens; identical to SEQ ID NO: 917033

SEQ ID NO: 1030525 - protein, 325 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 1030526 - protein, 206 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYDL

SEQ ID NO: 1030527 - protein, 364 aa, Homo sapiens; identical to SEQ ID NO: 917033

SEQ ID NO: 1030528 - protein, 303 aa, Homo sapiens
MLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 1030529 - protein, 201 aa, Homo sapiens
RYSTGSSRWRNGSICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 1030530 - protein, 243 aa, Homo sapiens
MVPGPAYAKYLATQKAICAHQWSPEIPSTDGGPMTLKAPAKLCDRRRVNGLPCLTKCKVGMAGEHWGYTPILSSTPLSTRAPAVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 1030531 - protein, 291 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAIGQRG

SEQ ID NO: 1030532 - protein, 201 aa, Homo sapiens
TKSSLYPRWANGSICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 1030533 - protein, 92 aa, Homo sapiens
KLCRRRFWSVVFFLAGRENASNNNWCRIRDEKIRDEKKLRTGAGGIPHSRTRTANQGYKVPVTQTVEKDSTAEFRTHQLGNDGDKGSRKADC

SEQ ID NO: 1030534 - protein, 178 aa, Homo sapiens
FGNRKRPQKHHLNQPSVAPGKTTSFPKKEVRQIDRKNQRLLKELSRQAEKPGEKSTIPRSADHPPKLYHSALNRQKEQQRIERENLALLKRLEAVKPTVGMKRSEQLMDYHRNMGYLNSSPLSRRARSTLGQYSPLRASRTSSATSGLSCRSERSAVDPSSGHPRRRPKPPNVRTAWL

SEQ ID NO: 1030535 - protein, 178 aa, Homo sapiens; identical to SEQ ID NO: 1030534

SEQ ID NO: 1030536 - protein, 178 aa, Homo sapiens; identical to SEQ ID NO: 1030534

SEQ ID NO: 1030537 - protein, 178 aa, Homo sapiens; identical to SEQ ID NO: 1030534

SEQ ID NO: 1030538 - protein, 178 aa, Homo sapiens; identical to SEQ ID NO: 1030534

SEQ ID NO: 1030539 - protein, 267 aa, Homo sapiens
MASNVTNKTDPRSMNSRVFIGNLNTLVVKKSDVEAIFFRSMAKLVGCSVHKGFAFVQYVNERNARAAVAGEDGRMIAGQVFRLLTWLQSQQVNRGNNAGVKRSAAEMYGSSLTWTMTFNGTIMNRTVQVNPARVPPPPPIARAVVPSKRQACIRKHFHEGPKWFQYLKSGQGRSSNAWTGCHENDPFRAIYERGGQIKRTGDPLRKRPGNIWRPRDQRRRRRERPKGHNTGEQGHRQARRRRHPRDGPRHKKGAHRRTNGARPEGTV

SEQ ID NO: 1030540 - protein, 672 aa, Homo sapiens
HPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLLSFASTSAKNDLDLNRSQTGKDCHLHRHFVDSVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSTKVSVSQVAQKQECKVSTTAPVTISQSVRQEVLFNPVLGSQAQLILSI

SEQ ID NO: 1030541 - protein, 672 aa, Homo sapiens; identical to SEQ ID NO: 1030540

SEQ ID NO: 1030542 - protein, 1599 aa, Homo sapiens
HPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLLSFASTSAKNDLDLNRSQTGKDCHLHRHFVDSVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSTKVSVSQVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKV

SEQ ID NO: 1030543 - protein, 1307 aa, Homo sapiens
HPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLLSFASTSAKNDLDLNRSQTGKDCHLHRHFVDSVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSTKVSVSQVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPVSDARFLVLMWALNRDDLET

SEQ ID NO: 1030544 - protein, 1460 aa, Homo sapiens
HPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLLSFASTSAKNDLDLNRSQTGKDCHLHRHFVDSVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSTKVSVSQVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKV

SEQ ID NO: 1030545 - protein, 1599 aa, Homo sapiens; identical to SEQ ID NO: 1030542

SEQ ID NO: 1030546 - protein, 1677 aa, Homo sapiens
HPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLLSFASTSAKNDLDLNRSQTGKDCHLHRHFVDSVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSTKVSVSQVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHR

SEQ ID NO: 1030547 - protein, 440 aa, Homo sapiens
MPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKV

SEQ ID NO: 1030548 - protein, 1219 aa, Homo sapiens
HPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLLSFASTSAKNDLDLNRSQTGKDCHLHRHFVDSVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSTKVSVSQVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKGKHN

SEQ ID NO: 1030549 - protein, 1626 aa, Homo sapiens
HPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLLSFASTSAKNDLDLNRSQTGKDCHLHRHFVDSVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSTKVSVSQVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGGIYSHFSHVGIILDFFKFLLRPGIVAHACNPSTLWEAKAGESRGQEIETILVNMVKTLSLLKNTKISQVWWRAHIVPATQEAEAGELLEPRRRGGCSELRLHYCTPAWATEQDSV

SEQ ID NO: 1030550 - protein, 490 aa, Homo sapiens
MHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKV

SEQ ID NO: 1030551 - protein, 75 aa, Homo sapiens
SEWRERAEWLCGRVSETGSACSMADQLTEEQIAEFKEAFSLFDKDGDGTITTTGIGNCNEISWAESHRSRVTGHD

SEQ ID NO: 1030552 - protein, 297 aa, Homo sapiens
SEWRERAEWLCGRVSETGSACSMADQLTEEQIADIPTVQLFPLICTTSMVHGNSSHHTHRHIGQLLMQHLIMGQQSPPASQQFPGTMHSMHTSALLHGHLAHNWHFPCNFLHTCTGPAHTMAHSTTATVHRTCNFSSTAHYRCRYCITAHEATSASSLPPGLPSTLISPNCWHLHPHTHMPPHRTVSPHALAHAQATRMQHVGIQGRTQHSNHYRHALHSRPQLQRPKLDHTVQCTATPRKLNHYITKTQRTPSATTTTCHIPTTHTPLFTYTQPSTHKHITATILSIYDHHPNKHK

SEQ ID NO: 1030553 - protein, 75 aa, Homo sapiens; identical to SEQ ID NO: 1030551

SEQ ID NO: 1030554 - protein, 75 aa, Homo sapiens; identical to SEQ ID NO: 1030551

SEQ ID NO: 1030555 - protein, 75 aa, Homo sapiens; identical to SEQ ID NO: 1030551

SEQ ID NO: 1030556 - protein, 119 aa, Homo sapiens
MASVSELACIYSALILHDDEVTVTEDKINALIKAAGVNVEPFWPGLFAKALANVNMWEPHLQCRGRWTCSSSWCCTSRRSLPPPLLLLQLRRRKWKQRKKNPRSLMMTWALVFLTKPLL

SEQ ID NO: 1030557 - protein, 119 aa, Homo sapiens; identical to SEQ ID NO: 1030556

SEQ ID NO: 1030558 - protein, 110 aa, Homo sapiens
NSRPRRHGCEKTTKGGVRKFKMAAAETQSLREQPEMEDANSEQSIHEDTWTKYQKTSLKISTVVTQNRSINTEVNIEKHKTASEEDKDKKDKHKQSNKKHKRKEVIDASE

SEQ ID NO: 1030559 - protein, 102 aa, Homo sapiens
SGHMRGSVFSFFLHFPYPPPSGSRRQRRRGVRKFKMAAAETQSLREQPEMEDANSEQSIHEDTWTKYQKTSLKISTVVTQNRSINTEVNIEKHKTCLRRRQG

SEQ ID NO: 1030560 - protein, 517 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLSSSRLSYQPAALGVGSADLAYPVVFAAGLNATHPHQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 1030561 - protein, 110 aa, Homo sapiens
TPVQNYTDIIINRAHTDVNKSDANTNSPISHPAGRLYNTILSLLNHCVKPCPQRVLNALTTPPWYELDENSILHKGTEASNSTTVSWPRVKTRPAFTQVDQAIHSFETTL

SEQ ID NO: 1030562 - protein, 301 aa, Homo sapiens
IGWCHPSYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNLQIPRNESPLTEPEFKWSRGAALIPEDLLKTSHASKELSTAGLIGVTPWTSILTLL

SEQ ID NO: 1030563 - protein, 480 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 1030564 - protein, 480 aa, Homo sapiens; identical to SEQ ID NO: 1030563

SEQ ID NO: 1030565 - protein, 480 aa, Homo sapiens; identical to SEQ ID NO: 1030563

SEQ ID NO: 1030566 - protein, 508 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSSLLPWALDQLTWLIQYVFAAGLNATHPHQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 1030567 - protein, 301 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSVRILKPYQTAVRDGPPLTMSWRPSLSEKWGLLSTNPLTR

SEQ ID NO: 1030568 - protein, 287 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSDSLPEKLAVHEKNVREFDAFVETLQ

SEQ ID NO: 1030569 - protein, 480 aa, Homo sapiens; identical to SEQ ID NO: 1030563

SEQ ID NO: 1030570 - protein, 130 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMDRLVSSFSTEGSSHSESSSFLSLIPAPFLSDILIIL

SEQ ID NO: 1030571 - protein, 108 aa, Homo sapiens
MRARNHSLCRSFAGTNFCGGYPRSLSAPGWEAVDLRPLGCCFVEVEGISHGSIPWAPEFSVGSGVGLGPVGPCLFGRESPPPQSFPLHFFSSLGEVVRRFGGNLGHNP

SEQ ID NO: 1030572 - protein, 480 aa, Homo sapiens; identical to SEQ ID NO: 1030563

SEQ ID NO: 1030573 - protein, 480 aa, Homo sapiens; identical to SEQ ID NO: 1030563

SEQ ID NO: 1030574 - protein, 480 aa, Homo sapiens; identical to SEQ ID NO: 1030563

SEQ ID NO: 1030575 - protein, 463 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMDSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 1030576 - protein, 518 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVSPPVDYEFPVDGALVIVLPEPESLSPTDYKPWPLGLRVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 1030577 - protein, 480 aa, Homo sapiens; identical to SEQ ID NO: 1030563

SEQ ID NO: 1030578 - protein, 485 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLLSPSTV

SEQ ID NO: 1030579 - protein, 156 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRRIT

SEQ ID NO: 1030580 - protein, 480 aa, Homo sapiens; identical to SEQ ID NO: 1030563

SEQ ID NO: 1030581 - protein, 405 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLPCSWPLPCLLSPSTV

SEQ ID NO: 1030582 - protein, 480 aa, Homo sapiens; identical to SEQ ID NO: 1030563

SEQ ID NO: 1030583 - protein, 480 aa, Homo sapiens; identical to SEQ ID NO: 1030563

SEQ ID NO: 1030584 - protein, 480 aa, Homo sapiens; identical to SEQ ID NO: 1030563

SEQ ID NO: 1030585 - protein, 480 aa, Homo sapiens; identical to SEQ ID NO: 1030563

SEQ ID NO: 1030586 - protein, 480 aa, Homo sapiens; identical to SEQ ID NO: 1030563

SEQ ID NO: 1030587 - protein, 480 aa, Homo sapiens; identical to SEQ ID NO: 1030563

SEQ ID NO: 1030588 - protein, 494 aa, Homo sapiens
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTPPQKGGGPLETTKRQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 1030589 - protein, 480 aa, Homo sapiens; identical to SEQ ID NO: 1030563

SEQ ID NO: 1030590 - protein, 480 aa, Homo sapiens; identical to SEQ ID NO: 1030563

SEQ ID NO: 1030591 - protein, 413 aa, Homo sapiens
KDYDNRMVNHFIAEFKRTHKKDISEKPESCKTPPYCLCNVLKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYAAVQAAILSGDKSENVQDLLLLACHSSCPLVIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTH

SEQ ID NO: 1030592 - protein, 413 aa, Homo sapiens; identical to SEQ ID NO: 1030591

SEQ ID NO: 1030593 - protein, 413 aa, Homo sapiens; identical to SEQ ID NO: 1030591

SEQ ID NO: 1030594 - protein, 357 aa, Homo sapiens
KDYDNRMVNHFIAEFKRTHKKDISEKPESCKTPPYCLCNVLKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYAAVQAAILSGDKSENVQDLLLLACHSSCPLVIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDENFRQITVRQQSSGQFMNYQLADKVSFRRRI

SEQ ID NO: 1030595 - protein, 160 aa, Homo sapiens
MDVTPLSLGIVETAWEVNDFSSIKAVIPTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDRFTKIISSFPQHEHFG

SEQ ID NO: 1030596 - protein, 413 aa, Homo sapiens
VISVTRDWTLSADNYCALGSVTFTREQESCKTPPYCLCNVLKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYAAVQAAILSGDKSENVQDLLLLACHSSCPLVIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTH

SEQ ID NO: 1030597 - protein, 186 aa, Homo sapiens
MQTEQSWSKLAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTH

SEQ ID NO: 1030598 - protein, 413 aa, Homo sapiens; identical to SEQ ID NO: 1030591

SEQ ID NO: 1030599 - protein, 413 aa, Homo sapiens; identical to SEQ ID NO: 1030591

SEQ ID NO: 1030600 - protein, 235 aa, Homo sapiens
MQIAFSQGLLSSIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTH

SEQ ID NO: 1030601 - protein, 413 aa, Homo sapiens; identical to SEQ ID NO: 1030591

SEQ ID NO: 1030602 - protein, 125 aa, Homo sapiens
MHKEEHEVAVLGAPPSTILPRSTVINIHSETSVPDHVVWSLFNTLFLNWCCLGFIAFAYSVKSRDRKMVGDVTGAQAYASTAKCLNIWALILGILMTIGFILLLVFGSVTVYHIMLQIIQEKRGY

SEQ ID NO: 1030603 - protein, 125 aa, Homo sapiens; identical to SEQ ID NO: 1030602

SEQ ID NO: 1030604 - protein, 86 aa, Homo sapiens
SVPLACNRAQHFLPQSQKMHKEEHEVAVLGAPPSTILPRSTVINIHSETSVPDHVVWSLFNTLFLNWCCMNPCCLGFIAFALLREV

SEQ ID NO: 1030605 - protein, 81 aa, Homo sapiens
AAAYYYYCSEFKLLTMYGDMTIWIHPVTGIRLCDSLPYYVTDNTGKTGLLVAAHSLQPLHSTVQCWPCTLGLLPLPPWSCP

SEQ ID NO: 1030606 - protein, 86 aa, Homo sapiens
EVVPDLRAGRANEETEPEHAALRWGILVPLHNPSPQSRDRKMVGDVTGAQAYASTAKCLNIWALILGILMTILLIVIPVLIFQAYG

SEQ ID NO: 1030607 - protein, 72 aa, Homo sapiens
MHKEEHEVAVLGAPPSTILPRSTVINIHSETSVPDHVVWSLFQHPSFEIVVLFWGFIAIGLIPLKLRGDGLG

SEQ ID NO: 1030608 - protein, 228 aa, Homo sapiens
MNHTVQTFFSPVNSGQPPNYEMLKEEHEVAVLGAPHNPAPPTSTVIHIRSETSVPDHVVWSLLPLLALGHSLGEFAHYCRERSQGIMGMMSCAERCRVGPRVAYVLPHAKLPGTSGHLYSGASLMIHSGSVLIHTMTRILPWRLLVLGVQDGPIIVDGQGTLMPRMEPVYSRTVTPRSSRFRRPVPPRKPSCRVSGPLLFLDSGFFYQSGHSIRVRRGFLGITYNTTK

SEQ ID NO: 1030609 - protein, 133 aa, Homo sapiens
MSHTVQTFFSPVNSGQPPNYEMLKEEHEVAVLGGPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAYG

SEQ ID NO: 1030610 - protein, 125 aa, Homo sapiens; identical to SEQ ID NO: 1030602

SEQ ID NO: 1030611 - protein, 133 aa, Homo sapiens; identical to SEQ ID NO: 1030609

SEQ ID NO: 1030612 - protein, 125 aa, Homo sapiens; identical to SEQ ID NO: 1030602

SEQ ID NO: 1030613 - protein, 133 aa, Homo sapiens; identical to SEQ ID NO: 1030609

SEQ ID NO: 1030614 - protein, 125 aa, Homo sapiens
MHKEEHEVAVLGAPPSTILPRSTVINIHSETSVPDHVVWSLFNTLFLNWCCLGFIAFAYSVKSRDRKMVGDVTGAQAYASTAKCLNIWALILGILMTIGFILSLVFGSVTVYHIMLQIIQEKRGY

SEQ ID NO: 1030615 - protein, 125 aa, Homo sapiens; identical to SEQ ID NO: 1030602

SEQ ID NO: 1030616 - protein, 125 aa, Homo sapiens; identical to SEQ ID NO: 1030602

SEQ ID NO: 1030617 - protein, 88 aa, Homo sapiens
MHKEEHEVAVLGAPPSTILPRSTVINIHSETSVPDHVVWSLLHLSDCAVWLIASLLVSLGQRWCDVTCQLCSRSADIWLICIYDIDHL

SEQ ID NO: 1030618 - protein, 261 aa, Homo sapiens
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWGKDEFHHFWILSCLSSSELPAFYSYIQKLCFPHFMGFFSVSLFFGRISKKSRRFIEK

SEQ ID NO: 1030619 - protein, 217 aa, Homo sapiens
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWGASPSTGAEEWTC

SEQ ID NO: 1030620 - protein, 166 aa, Homo sapiens
FDPQSALRNMAVAKHNLNIMIKRYNSTAATNEVPEVTVFSKSPVTLGQPNTLIVSCGGEDIVADHVASCGVNLYQFYGPSGQYTHEFDGDEQFYVDLERKETAWRWPEFSKSGVVCGPRGHCGGHCLHHPRPAFSWCFQTPRAIVNPILEGKVHRHLQEQKNGLAK

SEQ ID NO: 1030621 - protein, 237 aa, Homo sapiens
MILNKALLLGALALTTVMSPCGGEDIVADHVASCGVNLYQFYGPSGQYTHEFDGDEQFYVDLERKETAWRWPEFSKFGGFDPQGALRNMAVAEVPEVTVFSKSPVTLGQPNTLICLVDNIFPPVVNITWLSNGQSVTEGVSETSFLSKSDHSFFKISYLTFLPSADEIYDCKVEHWGLDQPLLKHWEPEIPAPMSELTETVVCALGLSVGLVGIVVGTVFIIQGLRSVGASRHQGPL

SEQ ID NO: 1030622 - protein, 170 aa, Homo sapiens
MILNKALLLGALALTTVMSPCGGEDIVADHVASCGVNLYQFYGPSGQYTHEFDGDEQFYVDLERKETAWRWPEFSKFGGFDPQGALRNMAVAEVPEVTVFSKSPVTLGQPNTLICPGVVCGPRGHCGGHCLHHPRPAFSWCFQTPRAIVNPILEGKVHRHLQEQKNGLAK

SEQ ID NO: 1030623 - protein, 255 aa, Homo sapiens [sequence omitted]

SEQ ID NO: 1030624 - protein, 255 aa, Homo sapiens [sequence omitted]

SEQ ID NO: 1030625 - protein, 202 aa, Homo sapiens
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 1030626 - protein, 202 aa, Homo sapiens; identical to SEQ ID NO: 1030625

SEQ ID NO: 1030627 - protein, 202 aa, Homo sapiens; identical to SEQ ID NO: 1030625

SEQ ID NO: 1030628 - protein, 202 aa, Homo sapiens; identical to SEQ ID NO: 1030625

SEQ ID NO: 1030629 - protein, 202 aa, Homo sapiens; identical to SEQ ID NO: 1030625

SEQ ID NO: 1030630 - protein, 202 aa, Homo sapiens; identical to SEQ ID NO: 1030625

SEQ ID NO: 1030631 - protein, 202 aa, Homo sapiens; identical to SEQ ID NO: 1030625

SEQ ID NO: 1030632 - protein, 214 aa, Homo sapiens
LQMGCCSLRMRHPPAVCQQISDAAGLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 1030633 - protein, 184 aa, Homo sapiens
MCYGKCARCIGHSLVGLALLCIAANILLYFPNGETKYASENHLSRFVWFFSGIVGGGLLMLLPAFVFIGLEQDDCCGCCGHGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 1030634 - protein, 113 aa, Homo sapiens
RLTGSQEESNGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 1030635 - protein, 202 aa, Homo sapiens; identical to SEQ ID NO: 1030625

SEQ ID NO: 1030636 - protein, 201 aa, Homo sapiens
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQRIEC

SEQ ID NO: 1030637 - protein, 224 aa, Homo sapiens
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQTSYDWLKRNQTQGTGHKSFPPFQLVNF

SEQ ID NO: 1030638 - protein, 202 aa, Homo sapiens; identical to SEQ ID NO: 1030625

SEQ ID NO: 1030639 - protein, 202 aa, Homo sapiens; identical to SEQ ID NO: 1030625

SEQ ID NO: 1030640 - protein, 198 aa, Homo sapiens
DVHSRRSPVLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 1030641 - protein, 143 aa, Homo sapiens [sequence omitted]

SEQ ID NO: 1030642 - protein, 128 aa, Homo sapiens
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIASTLWNGMYLCFLSSWLLVELNSSCVLFK

SEQ ID NO: 1030643 - protein, 183 aa, Homo sapiens
MCYGKCARCIGHSLVGLALLCIAANILLYFPNGETKYASENHLSRFVWFFSGIVGGGLLMLLPAFVFIGLEQDDCCGCCGHGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQRIEC

SEQ ID NO: 1030644 - protein, 202 aa, Homo sapiens; identical to SEQ ID NO: 1030625

SEQ ID NO: 1030645 - protein, 202 aa, Homo sapiens; identical to SEQ ID NO: 1030625

SEQ ID NO: 1030646 - protein, 202 aa, Homo sapiens; identical to SEQ ID NO: 1030625

SEQ ID NO: 1030647 - protein, 187 aa, Homo sapiens
DKGRRVHLATVSASAAWDALGLPVRSHMQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLI

SEQ ID NO: 1030648 - protein, 293 aa, Homo sapiens
DKGRRVHLATVSASAAWDALGLPVRSHMQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 1030649 - protein, 330 aa, Homo sapiens
VCGTRGLGSWGFPLLDGETEAQTGAAENSGLGCPPATHTQTSKNLTILVKNIFNRNYDLTVRSHMQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 1030650 - protein, 137 aa, Homo sapiens
EGWEDHQPGSGPVASRCTQEAKARPSEHKDCEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 1030651 - protein, 91 aa, Homo sapiens
MCWAALALKKFFNPLRWARGPRWLVDCGQERVPGEIRANRRRCLDFFPRLYKSRGGQRMCFLNNLQSEVGRKREPHYQGCPQKLEKILVCG

SEQ ID NO: 1030652 - protein, 137 aa, Homo sapiens; identical to SEQ ID NO: 1030650

SEQ ID NO: 1030653 - protein, 293 aa, Homo sapiens; identical to SEQ ID NO: 1030648

SEQ ID NO: 1030654 - protein, 293 aa, Homo sapiens; identical to SEQ ID NO: 1030648

SEQ ID NO: 1030655 - protein, 241 aa, Homo sapiens
MGVMTDVHRRFLQLLMTHGVLEEWDVKRLQTHCYKVHDRNATVDKLEDFINNINSVLESLYIEIKRGVTEDDGRPIYALVNLATTSISELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 1030656 - protein, 240 aa, Homo sapiens
DKGRRVHLATVSASAAWDALGLPVRSHMQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQKSSTLRRRGSLVS

SEQ ID NO: 1030657 - protein, 91 aa, Homo sapiens; identical to SEQ ID NO: 1030651

SEQ ID NO: 1030658 - protein, 321 aa, Homo sapiens
DKGRRVHLATVSASAAWDALGLPVRSHMQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAERAAPLQDYWPTRSKSFDPERRGSRGWIRQKSVARTDNTAGEAGPDGERHLWRRRGRTEDTGMDGSWDTR

SEQ ID NO: 1030659 - protein, 293 aa, Homo sapiens; identical to SEQ ID NO: 1030648

SEQ ID NO: 1030660 - protein, 333 aa, Homo sapiens
MGVMTDVHRRFLQLLMTHGVLEEWDVKRLQTHCYKVHDRMSFISLTSEKEKQDPFWLASALVAEGLLRAQGLLSWASSTPAPPSHPGPALPCPQCCASRTARPPCLSGGLSEGNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 1030661 - protein, 176 aa, Homo sapiens
FLHVFRVFASGVPCQRLCQGDVADARWLGLEKSCVDPCVFLSTGLWDHRGKRGGEWGEGLAEGGHLLCVPEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 1030662 - protein, 70 aa, Homo sapiens
MGVMTDVHRRFLQLLMTHGVLEEWDVKRLQTHCYKVHDRVPFPCSQGRSGCCVDQGPVTEVQYHVNLFNR

SEQ ID NO: 1030663 - protein, 79 aa, Homo sapiens
MIGAGSGCEVFKTRAVGQFAYSFHVFVVVGRILLFFLPRGGSSSNAPIILWVYGLQGIAETYDLMLFSKADPYFLGLVC

SEQ ID NO: 1030664 - protein, 67 aa, Homo sapiens
AQIFPWVILLDGSLMYKYIFFGVISIYKSISSDAEPFDSAKDFGGENFFLRVFAAGGGGKVSIDRSV

SEQ ID NO: 1030665 - protein, 369 aa, Homo sapiens
MHHNKQATENAKEEVRRILGLLDAYLKTRTFLVGERVTLADITVVCTLLWLYKQVLEPSFRQAFPNYQPVAAEPKAKDPFSSSPCINQPQFRAVLGEVKLCEKMASLVLKSVAETQPKKDNPGKSKGSTAKRSRRPQAERKEDEQGGAPAPEEEMDECEQALVLEPKAKDPVPHRAQEYLLLFAMRFKAASYSQLRTHSHVGTVQYSLAQTQLCITDRTWYPGEYYRRIDFLLKGISTQEPSMTLHIFIDVDIFQQTGTRLRTEVPYVQMSSYLRKPTNSSVHFWQSGIFRGQGACLSDESRLARWTTSHNNIGENWILASEEDPERWFESTYPWERGPFQHVGKSIQVQGKDLQVNILFAITLTALNF

SEQ ID NO: 1030666 - protein, 361 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGHHAPQAEDPRLSGRRTNKAAAPAPEEEMDECEQALVLEPKAKDPVPHRAQEYLLLFAMRFKAASYSQLRTHSHVGTVQYSLAQTQLCITDRTWYPGEYYRRIDFLLKGISTQEPSMTLHIFIDVDIFQQTGTRLRTEVPYVQMSSYLRKPTNSSVHFWQSGIFRGQGACLSDESRLARWTTSHNNIGENWILASEEDPERWFESTYPWERGPFQHVGKSIQVQGKDLQVNILFAITLTALNF

SEQ ID NO: 1030667 - protein, 266 aa, Homo sapiens
MASLVLKSVAETQPKKDNPGKSKGSTAKRSRRPQAERKEDEQGGAPAPEEEMDECEQALVLEPKAKDPFAHRAQEYLLLFAMRFKAASYSQLRTHSHVGTVQYSLAQTQLCITDRTWYPGEYYRRIDFLLKGISTQEPSMTLHIFIDVDIFQQTGTRLRTEVPYVQMSSYLRKPTNSSVHFWQSGIFRGQGACLSDESRLARWTTSHNNIGENWILASEEDPERWFESTYPWERGPFQHVGKSIQVQGKDLQVNILFAITLTALNF

SEQ ID NO: 1030668 - protein, 190 aa, Homo sapiens
MTEWETAAPAVAETPDIKLFGKWSTDDVQINDISHVSVLAFARDMDDSSAEVDRCCCDELARAGELPALDTSVFASNMLQVVIHVWQATSSSTSHDSGWHGPFKQTRLSKASMGLMAGNSDQKQLTPCGRNTIATLAFSSVAGIRYVPMGCHVGAKRQSTRQPAAITARDGTCSNSGEFAGSRAGDWVKD

SEQ ID NO: 1030669 - protein, 204 aa, Homo sapiens [sequence omitted]

SEQ ID NO: 1030670 - protein, 231 aa, Homo sapiens
GSPYLIDTLRLCSLGFSYGSTAGLREVGFRRQDFSVSFGNVEQPYDVPYRSPLLCLLAVTVVSDEKISCQGAVLRVQGGMPMTSVREVQLSLLCARLNNVSCMIHRAPQRALTFMTVRIVKHAFEIIHLLTGENPLQVLVNAIINSGPREDSTRIGRAGTVRRQAVDVSPLRRVNQAIWLLCTGAREAAFRNIKTIAECLADELINAAKGSSNSYAIKKKDELERVAKSNR

SEQ ID NO: 1030671 - protein, 204 aa, Homo sapiens [sequence omitted]

SEQ ID NO: 1030672 - protein, 201 aa, Homo sapiens
YKSHLSRCEWNAPAWRTRIQFWSEPYCDHDFLQDYIAVKEKYAKYLPHSAGRYAAKRFRKAQCPIVERLTNSMMMHGRNNGKKLMTVRIVKHAFEIIHLLTGENPLQVLVNAIINSGPREDSTRIGRAGTVRRQAVDVSPLRRVNQAIWLLCTGAREAAFRNIKTIAECLADELINAAKGSSNSYAIKKKDELERVAKSNR

SEQ ID NO: 1030673 - protein, 360 aa, Homo sapiens
MEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMHSKLPEEEGLGEKTKLNPFKFVGLKNFPCTPESLCDVLSMDFPFEVDGLLFYHKQTHYSPGSTPLVGWLRPYMVSDVLGVAVPAGPLTTKPDYAGHQLQQIMEHKKSQKEGMKEKLTHKASENGHYELEHLSTPKLKGSSHSPDHPGCLMEN

SEQ ID NO: 1030674 - protein, 469 aa, Homo sapiens
RKAREDLREAAGPRALNARPQDQPPPIGERSPEELVFRREASAWSSHLAGRVPDSAKQMQEDPLPSRWEMPQPLKAEITACRQRNSQRSQRSGGAGNSGREACGPSGGKMEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMHSKLPEEEGLGEKTKLNPFKFVGLKNFPCTPESLCDVLSMDFPFEVDGLLFYHKQTHYSPGSTPLVGWLRPYMVSDVLGVAVPAGPLTTKPDYAGHQLQQIMEHKKSQKEGMKEKLTHKASENGHYELEHLSTPKLKGSSHSPDHPGCLMEN

SEQ ID NO: 1030675 - protein, 360 aa, Homo sapiens; identical to SEQ ID NO: 1030673

SEQ ID NO: 1030676 - protein, 360 aa, Homo sapiens; identical to SEQ ID NO: 1030673

SEQ ID NO: 1030677 - protein, 360 aa, Homo sapiens; identical to SEQ ID NO: 1030673

SEQ ID NO: 1030678 - protein, 360 aa, Homo sapiens; identical to SEQ ID NO: 1030673

SEQ ID NO: 1030679 - protein, 376 aa, Homo sapiens
TLEVPLEFDGFSLLGKMEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMHSKLPEEEGLGEKTKLNPFKFVGLKNFPCTPESLCDVLSMDFPFEVDGLLFYHKQTHYSPGSTPLVGWLRPYMVSDVLGVAVPAGPLTTKPDYAGHQLQQIMEHKKSQKEGMKEKLTHKASENGHYELEHLSTPKLKGSSHSPDHPGCLMEN

SEQ ID NO: 1030680 - protein, 247 aa, Homo sapiens
MEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMHSKLPEEEGLGEKTKLNPVRPGVRITEFLMGSSVDWSVI

SEQ ID NO: 1030681 - protein, 360 aa, Homo sapiens; identical to SEQ ID NO: 1030673

SEQ ID NO: 1030682 - protein, 222 aa, Homo sapiens
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPLTTNLISLLAENGRLSNTQGVVSAFSTMMSVHRGEVPCTVTSASPLEEATLSELKTVLKSFLSQGQVLKLEAKTDPSILGGMIVRIGEKYVDMSVKDQDSEAGQGYAGDCLKVLVSCHQ

SEQ ID NO: 1030683 - protein, 179 aa, Homo sapiens
YRLGIGSVFNRRGCPECGKGFRRSSDLVKHHRVHTGEKPYLCPECGKGFADSSARVKHLRTHRGERARPPPPSTLLRPHNPPGPVPMAPRPRVRAQPSGPSQPHVCGFCGKEFPRSSDLVKHRRTHTGEKPYKCAECGKGFGDSSARIKHQRGHLVLTPFGIGDGRARPLKQEAATGLE

SEQ ID NO: 1030684 - protein, 208 aa, Homo sapiens
AQPPVTPRVLTLGEPFACLGAQSLGPTGWEPPPPLAGDKPHKCPECGKGFRRSSDLVKHHRVHTGEKPYLCPECGKGFADSSARVKHLRTHRGERARPPPPSTLLRPHNPPGPVPMAPRPRVRAQPSGPSQPHVCGFCGKEFPRSSDLVKHRRTHTGEKPYKCAECGKGFGDSSARIKHQRGHLVLTPFGIGDGRARPLKQEAATGLE

SEQ ID NO: 1030685 - protein, 102 aa, Homo sapiens
MCEKVPFRVVILMTEVLEPNNTFFIFILFLKDELWSFSGRRLFPFPRIKTRIRPARSRSLSFARSGAHAPCSGPRWTYPRRHLPRQTRLSPGDFPQPSAAFP

SEQ ID NO: 1030686 - protein, 311 aa, Homo sapiens
MRGAARAAWGRAGQPWPRPPAPGPPPPPLPLLLLLLAGLLGGAGAQYSSDRCSWKGSGLTHEAHRKEVEQVYLRCAAGAVEWMYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 1030687 - protein, 311 aa, Homo sapiens; identical to SEQ ID NO: 1030686

SEQ ID NO: 1030688 - protein, 294 aa, Homo sapiens
MRGAARAAWGRAGQPWPRPPAPGPPPPPLPLLLLLLAGLLGGAGAQYSSDRCSWKGSGLTHEAHRKEVEQVYLRCAAGAVEWMYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGPTLQGLPEDVQGCPGEGAEPL

SEQ ID NO: 1030689 - protein, 161 aa, Homo sapiens
MKKTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLPLK

SEQ ID NO: 1030690 - protein, 161 aa, Homo sapiens; identical to SEQ ID NO: 1030689

SEQ ID NO: 1030691 - protein, 118 aa, Homo sapiens
IPMVLSCILGSKAGSMSKQELDDILKFGTEELFKDENEGENKEEDSSVIHYDNEAIARLLDRNQDATEDTDVQNMNEYLSSFKVAQYVVREEDKVRGFGGQTLSIPGHLQKAVSFTQP

SEQ ID NO: 1030692 - protein, 1106 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030693 - protein, 1072 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSEDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030694 - protein, 972 aa, Homo sapiens
LAQLPPCSALAPFSGTGDKGASRDETPFKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030695 - protein, 1091 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKGLPAGSLRYTSGVRGGLQRRTRRGPGRRRRQLQPDACRVLHHSRHQRPSSACEEGEGNGGGIGVRRAGSEGAPSRGGDLYRRLTGSQACPSPRPRPRGRPPAQALGPAASPPPSPPLGPSLG

SEQ ID NO: 1030696 - protein, 796 aa, Homo sapiens
IPMVLSCILGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030697 - protein, 1106 aa, Homo sapiens; identical to SEQ ID NO: 1030692

SEQ ID NO: 1030698 - protein, 858 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030699 - protein, 1106 aa, Homo sapiens; identical to SEQ ID NO: 1030692

SEQ ID NO: 1030700 - protein, 1106 aa, Homo sapiens; identical to SEQ ID NO: 1030692

SEQ ID NO: 1030701 - protein, 306 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030702 - protein, 1101 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGLTSHPWPGKCQRLIEDPTRTDNTDPAAYQP

SEQ ID NO: 1030703 - protein, 857 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTGWGDSRCFLLLKGICSSSWGFSFCLRLPATFNSK

SEQ ID NO: 1030704 - protein, 770 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATELTPGVGGRDTLDDIPRGQLS

SEQ ID NO: 1030705 - protein, 444 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKLCFLSWFSKIPTYLPNVPFTPASSQTSRTAATLGSAWSPY

SEQ ID NO: 1030706 - protein, 221 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGKVFAGG

SEQ ID NO: 1030707 - protein, 1121 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKGKGRGGPRGGGPTTLLLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030708 - protein, 1144 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSAGGCMALGVMGIRIWDFPLLGSGDEGNILPSYPLPPPTATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030709 - protein, 1234 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTGWGDSRCFLLLKGICSSSWGFSFCLRLPATFNFQVTSNEVCCMLTPILALNLSEVSLLTPKLALIPPLFLILTNLVRTEFVPNLTFTHSSSGALQFPFIIQFLHLYLSVGLSAVCKTLLPLLSAAFFAELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030710 - protein, 1106 aa, Homo sapiens; identical to SEQ ID NO: 1030692

SEQ ID NO: 1030711 - protein, 740 aa, Homo sapiens
MPTGGDYLTCSNINHSHPVSISRFAQYVSEFKNTFRGNIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSATESTPGERGEEKPLDGQEHRERPEGETGDLGKREDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFITAATNGPPVLVKKEKEMVGALVSDGLDRKEPRAGEVICIDD

SEQ ID NO: 1030712 - protein, 1106 aa, Homo sapiens; identical to SEQ ID NO: 1030692

SEQ ID NO: 1030713 - protein, 1106 aa, Homo sapiens; identical to SEQ ID NO: 1030692

SEQ ID NO: 1030714 - protein, 163 aa, Homo sapiens [sequence omitted]

SEQ ID NO: 1030715 - protein, 248 aa, Homo sapiens
MPLFSWLHLCISLSFSCPSFSVARAPVLNQLEELLSDMKADVTRLPATLSRIPPIAARLQMSERSILSRLASKGTEPHPTPVTLFPPSSSSLFVFLLHTYKHFHQNPIQYGKTTCQNTVITLERVSLPVYPTLSSCRSVAHNVISYSFFPLTDYELTPNFCFLLFQAYPPGPYATPPGYGAAFSAAPVGALAAAGANYSQMPAGSFITAATNGPPVLVKKEKEMVGALVSDGLDRKEPRAGEVICIDD

SEQ ID NO: 1030716 - protein, 484 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGQNIRCILKSQLW

SEQ ID NO: 1030717 - protein, 428 aa, Homo sapiens
FFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKVRGFGGQTLSIPGHLQKAVSFTQP

SEQ ID NO: 1030718 - protein, 511 aa, Homo sapiens
TRSICPGGEQPAMKSSSLPCWDLMPDISQSVLDASLLQKQIMLGFSPAPGADSSQCWSLPAIVRPEFPRQSVAVPLGNFRENGFCTRAIVLTYQEHLGVTYLTLSEDPSPRVIIHNRCPVKMLIKENIKDIPKFEVYCKKIPSECSIHHELYHQISSYPDCKTKDLLPSLLLRVEPLDEVTTEWSDAIDINSQGTQVVFLTGFGYVYVDVVHQCGTVFITVAPEGKAGPILTNTNRAPEKIVTFKMFITQLSLAVFDDLTHHKASAELLRLTLDNIFLCVAPGAGPLPGEEPVAALFELYCVEICCGDLQLDNQLYNKSNFHFAVLVCQGEKAEPIQCSKMQSLLISNKELEEYKEKCFIKLCITLNEGKSILCDINEFSFELKPARLYVEDTFVYYIKTLFDTYLPNSRLAGHSTHLSGGKQVLPMQVTQHARALGGILWKLRKLGDSQPVNLLVSIHASLKLYIASDHTPLSFSVFERGPIFTTARQLVHALAMHYAAGALFRAGKNTS

SEQ ID NO: 1030719 - protein, 250 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITCLEGGAQVTHRKCEGQDPGLTEGIPPDQQRLIFAGKQLEDGRTLSDYNIQKESTLHLVLRLRGGMQIFVKSLTGETISLEVEPSDTSRKCEGQDPRYKKESAPDQQRLIWAGSAVEDGALFSDYNIQKESDLTWSALRGGCNSGSRHSKCQGWLVCYRHL

SEQ ID NO: 1030720 - protein, 147 aa, Homo sapiens
LNRFWMAVLMFLIFTLGCGMQIFVKTLTGKTITLEVEPSDTIENVKAKIQDKEGIPPDQQRLIFAGKQLEDGRTLSDYNIQKESTSAPWCSLRLRGGMQIFVKTLTGKTITLDVEPSVTTKKVKQEDRRTFLTTVSKKSPPCACSWV

SEQ ID NO: 1030721 - protein, 161 aa, Homo sapiens
MWHAYFVYTLYWSHTHSRNWSEMHSIVNVKARSYDTERYSLLSQQRLIFAGKQLEDGRTLSDYNIQKESTLHLVLRLRGGMQIFVKTLTGNTITLRSGAEMTPIENVKAKIQDKEGIPPDQQRLIFAGKQLEDGRTLSDYNIQKESTLHLVRMLRYRARVY

SEQ ID NO: 1030722 - protein, 64 aa, Homo sapiens
MNDSVPEHEYWVKAPQIVLESYRPNFLHRKNFGSHNAARHKRELPPKDTHNWGKQRAQSSPHYT

SEQ ID NO: 1030723 - protein, 96 aa, Homo sapiens
DMESQFLFVDCCDRHLTMQIFVKTLTGKTITLEVEPSDTIENVKAKIQDKEGIPPDQQRLIFAGKQLEDGRTLSDYNIQKESTSAPWCSRLQRWEC

SEQ ID NO: 1030724 - protein, 96 aa, Homo sapiens; identical to SEQ ID NO: 1030723

SEQ ID NO: 1030725 - protein, 129 aa, Homo sapiens
MSRAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 1030726 - protein, 159 aa, Homo sapiens
MQIFVKTLTGKTITLEVASKVEPSPVTPLRMSRAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 1030727 - protein, 96 aa, Homo sapiens; identical to SEQ ID NO: 1030723

SEQ ID NO: 1030728 - protein, 98 aa, Homo sapiens
LNRFWMAVLMFLIFTLGCGMQIFVKTLTGKTITLEVEPSDTIENVKAKIQDKEGIPPDQQRLIFAGKQLEDGRTLSDYNIQKESTSAPWCSRLQRWEC

SEQ ID NO: 1030729 - protein, 96 aa, Homo sapiens; identical to SEQ ID NO: 1030723

SEQ ID NO: 1030730 - protein, 129 aa, Homo sapiens; identical to SEQ ID NO: 1030725

SEQ ID NO: 1030731 - protein, 96 aa, Homo sapiens; identical to SEQ ID NO: 1030723

SEQ ID NO: 1030732 - protein, 96 aa, Homo sapiens; identical to SEQ ID NO: 1030723

SEQ ID NO: 1030733 - protein, 159 aa, Homo sapiens; identical to SEQ ID NO: 1030726

SEQ ID NO: 1030734 - protein, 374 aa, Homo sapiens
SSPVCSSPICVLISTCVLILTCGSIPTCVLIPTCVLIPTCVLIPTCVLIPTCVLRLRGGMQIFVKTLTGKTITLEVEPSDTIENVKAKIQDKEGIPPDQQRLIFAGKQLEDGRTLSDYNIQKESTSAPWCSRLQRVGVLSLRDMTPDCVRPSPLEVEPSDTIENVKAKIQDKEGIPPDQQRLIFAGKQLEDGRTLSDYNIQKESTLHLVLRLRGGMQIFVKTLTGKTITLEVASTVEPSPVTPLRMSRAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 1030735 - protein, 311 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVASKVEPSPVTPLRMSRAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 1030736 - protein, 140 aa, Homo sapiens
PHLCAPAPSVCSSPPVCSSSPVCSIPTCVLIPTCVLIPTCVLIPTCVLIPTCVLRLRGGMQIFVKTLTGKTITLEVEPSDTIENVKAKIQDKEGIPPDQQRLIFAGKQLEDGRTLSDYNIQKESTSAPWCSVSEVGCKSS

SEQ ID NO: 1030737 - protein, 96 aa, Homo sapiens; identical to SEQ ID NO: 1030723

SEQ ID NO: 1030738 - protein, 96 aa, Homo sapiens; identical to SEQ ID NO: 1030723

SEQ ID NO: 1030739 - protein, 152 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITEVEPSDTIENVKAKIQDKEGIPPDQQRLIFAGKQLEDGRTLSDYNIQKESTLHLVLRLRGGY

SEQ ID NO: 1030740 - protein, 152 aa, Homo sapiens; identical to SEQ ID NO: 1030739

SEQ ID NO: 1030741 - protein, 140 aa, Homo sapiens; identical to SEQ ID NO: 1030736

SEQ ID NO: 1030742 - protein, 150 aa, Homo sapiens
MQIFVKTLTGKTITLEVEPSDTIENVKAKIQDKEGIPPDQQRLIFAGKQLEDGRTLSDYNIQKESTLHLVLRLRDGMQIFVRPDRRPHLEVEPMTPRNVRPDPDKKAPPDQQRLIFAGKQLEDGRTLSDYNIQKESTLHLVLRLSLRGGC

SEQ ID NO: 1030743 - protein, 243 aa, Homo sapiens
MDASCVTTISRKSEPESGSSGLELGMQIFVKTLTGKTITLEVEPSDTIENVKAKIQDKEGIPPDQQRLIFAGKQLEDGRTLSDYNIQKESTSAPWCSLQRWDANLREDPRLVKTITLEVEPSDTIENVKAKIQDKEGIPPDQQRLIFAGKQLEDGRTLSDYNIQKESTLHLVLRLRGGMQIFVQDHVTGKTISSRRGAELTALHECPGQDPRHTERHSLLNQHYCRTRSPESHAGQMRALPVT

SEQ ID NO: 1030744 - protein, 150 aa, Homo sapiens; identical to SEQ ID NO: 1030742

SEQ ID NO: 1030745 - protein, 90 aa, Homo sapiens
LPYLGPLPNGFWACRFNSTSKFVVFPRFIPFPNFGKDPETRKASLLSQAEVDLVPEKQLEGWTHPVLTTTSRKESTLHLVLLVLRLRGGV

SEQ ID NO: 1030746 - protein, 92 aa, Homo sapiens
PFRALAPIRGGMQIFVKTLTGKTITLEVEPSDTIENVKAKIQDKEGIPPDQQRLIFAGKQLEDGRTLSDYNIQKESTSAPWCSVSEVGCKSS

SEQ ID NO: 1030747 - protein, 278 aa, Homo sapiens
SSPVCSSPICVLISTCVLILTCGSIPTCVLIPTCVLIPTCVLIPTCVLIPTCVLRLRGGMQIFVKTLTGKTITLEVEPSDTIENVKAKIQDKEGIPPDQQRLIFAGKQLEDGRTLSDYNIQKESTSAPWCSRLQRVGVLSLRDMTPDCVRPSPLEVEPSDTIENVKAKIQDKEGIPPDQQRLIFAGKQLEDGRTLSDYNIQKESTLHLVLRLRGGMQIFVKTLTGKTITLEVVKPIDPLENVKCKDPRNGRLSFDQQRLIFARKATWEKGPPWLITNI

SEQ ID NO: 1030748 - protein, 119 aa, Homo sapiens
PRMKCKPSPDKRHPSGPQGYRATAESPTLSDSPSRRVSVTWAFSSSVKTLTGKTITLEVEPSDTIENVKAKIQDKEGIPPDQQRLIFAGKQLEDGRTLSDYNIQKESTLHLVLRLRGGC

SEQ ID NO: 1030749 - protein, 79 aa, Homo sapiens
PHLCAPAPSVCSSPPVCSSSPVCSIPTCVLIPTCVLIPTCVLIPTCVLIPTCVLRLRGGHTQHTDEHTAHTQTHSTHTH

SEQ ID NO: 1030750 - protein, 96 aa, Homo sapiens; identical to SEQ ID NO: 1030723

SEQ ID NO: 1030751 - protein, 130 aa, Homo sapiens
MQIFVKTLTGKTITLEVEPSDTIENVKAKIQDKEGIPPDQQRLIFAGKQLEDGRTLSDYNIQKESTLHLVLRLSLRLRGGMQIFVKTLTGKTITLDVEPSVTTKKVKQEDRRTFLTTVSKKSPPCACSWV

SEQ ID NO: 1030752 - protein, 138 aa, Homo sapiens
PHLCAPAPSVCSSPPVCSSSPVCSIPTCVLIPTCVLIPTCVLIPTCVLIPTCVLRLRGGMQIFVKTLTGKTITLEVEPSDTIENVKAKIQDKEGIPPDQQRLIFAGKQLEDGRTLSDYNIQKESTSAPWCSRLQRWEC

SEQ ID NO: 1030753 - protein, 159 aa, Homo sapiens
MQIFVKTLTGKTITLEVASTVEPSPVTPLRMSRAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 1030754 - protein, 159 aa, Homo sapiens
MWHAYFVYTLYWSHTHSRNWSEMHSIVNVKARSYDTERYSLLSQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTSAPWCSRLQRWEC

SEQ ID NO: 1030755 - protein, 96 aa, Homo sapiens; identical to SEQ ID NO: 1030723

SEQ ID NO: 1030756 - protein, 96 aa, Homo sapiens; identical to SEQ ID NO: 1030723

SEQ ID NO: 1030757 - protein, 159 aa, Homo sapiens; identical to SEQ ID NO: 1030753

SEQ ID NO: 1030758 - protein, 337 aa, Homo sapiens
MDASCVTTISRKSEPESGSSGLELGMQIFVKTLTGKTITLEVEPSDTIENVKAKIQDKEGIPPDQQRLIFAGKQLEDGRTLSDYNIQKESTSAPWCSLQRWDANLREDPRLVKTITLEVEPSDTIENVKAKIQDKEGIPPDQQRLIFAGKQLEDGRTLSDYNIQKESTLHLVLRLRGGMQIFVKTLTGKTITLEVASKVEPSPVTPLRMSRAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 1030759 - protein, 311 aa, Homo sapiens; identical to SEQ ID NO: 1030735

SEQ ID NO: 1030760 - protein, 96 aa, Homo sapiens; identical to SEQ ID NO: 1030723

SEQ ID NO: 1030761 - protein, 96 aa, Homo sapiens; identical to SEQ ID NO: 1030723

SEQ ID NO: 1030762 - protein, 234 aa, Homo sapiens
MWHAYFVYTLYWSHTHSRNWSEMHSIVNVKARSYDTERYSLLSQQRLIFAGKQLEDGRTLSDYNIQKESTLHLVLRLRGGMQIFVKTLTGNTITLRSGAEMTPIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 1030763 - protein, 119 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITFSRWSPVTPLRMSRQRSKTRKASLLTSRG

SEQ ID NO: 1030764 - protein, 119 aa, Homo sapiens
MQIFVKTLTGKTITLEVEPSDTIENVKAKIQDKEGIPPDQQRLIFAGKQLEDGRTLSDYNIQKESTLHLVLRGGGGGGGGGGGGGGGGGAPGPALRGGMQIFVKTLTGKTITCLEGGAQ

SEQ ID NO: 1030765 - protein, 142 aa, Homo sapiens
FYPTLEVEPSDTIENVKAKIQDKEGIPPDQQRLIFAGKQLEDGRTLSDYNIQKESTLHLVLRLRGGMQIFVIDPHLLRSSSSTVEPSPVTPLRMSRAKIQDKEGMQRLIFAGKQLEDGRTLSDYNIQKESTLHLVLRLRGGV

SEQ ID NO: 1030766 - protein, 140 aa, Homo sapiens
PHLCAPAPSVCSSPPVCSSSPVCSIPTCVLIPTCVLIPTCVLIPTCVLIPTCVLRLRGGMQIFVKTLTGKTITLEVEPSDTIENVKAKIQDKEGIPPDQQRLIFAGTSRGSSLQASSWKMAALFLTTTSRKSRPCTWSCV

SEQ ID NO: 1030767 - protein, 184 aa, Homo sapiens
MSGARAAPGAAGNGAVRGLRVDGLPPLPKSLSGLLHSASGGGASGGWRHLERLYAQKSRIQDELSRGGPGGGGARAAALPAKPPNLDAALALLRKEMVGLRQLDMSLLCQLYSLYESIQEYKGACQAASSPDCTYALENGFFDEEEEYFQEQNSLHDRRDRGPPRDLSLPVSSLSSSDWILESI

SEQ ID NO: 1030768 - protein, 128 aa, Homo sapiens
LNHAPCGRNVLAGADRRLSVPLKLNSSADFSFFTSPPPSLKVGLRQLDMSLLCQLYSLYESIQEYKGACQAASSPDCTYALENGFFDEEEEYFQEQNSLHDRRDRGPPRDLSLPVSSLSSSDWILESI

SEQ ID NO: 1030769 - protein, 196 aa, Homo sapiens
AAVAGAWPGRGAMSGARAAPGAAGNGAVRGLRVDGLPPLPKSLSGLLHSASGGGASGGWRHLERLYAQKSRIQDELSRGGPGGGGARAAALPAKPPNLDAALALLRKEMVGLRQLDMSLLCQLYSLYESIQEYKGACQAASSPDCTYALENGFFDEEEEYFQEQNSLHDRRDRGPPRDLSLPVSSLSSSDWILESI

SEQ ID NO: 1030770 - protein, 192 aa, Homo sapiens
ASYASDSGLEGGHAKVSLQPQDVPLTTLLEPDSFAIEVGGHISRRQKLPWSDREGPVRRGLSRRLTWSIYVRVYLYPMRRMQGEPVVHVKISTAYRGPRGKGMVKLLGSPSYWTRCHHLLLLLQESTSVVDGPRAQGMSATSFICRQGVLRGCMVAVCFDGSSFCLGDLEVLSSILHTYLLRCTCWGFIMRI

SEQ ID NO: 1030771 - protein, 209 aa, Homo sapiens
MFTVFEVSKVGLAFLLTAAGTAGQGRAEASAPGARSDLPGSGAPSRPRGEWEAAGGGLDSALGEGRGSWDQSQASCPDVLPVVSQSLGTPTPCNGCFVGSEAGPPPGQGRDRRRQGAEERWQVGLRQLDMSLLCQLYSLYESIQEYKGACQAASSPDCTYALENGFFDEEEEYFQEQNSLHDRRDRGPPRDLSLPVSSLSSSDWILESI

SEQ ID NO: 1030772 - protein, 196 aa, Homo sapiens; identical to SEQ ID NO: 1030769

SEQ ID NO: 1030773 - protein, 178 aa, Homo sapiens
PWKLLIVLEFKVENKGPQIAGFEHSMFFLNEPVCIFKTCAFKRELYFLNPAVNVETSRPPRACENTPLRSRLLLLGEWLARRLPSHSFSGRVGLRQLDMSLLCQLYSLYESIQEYKGACQAASSPDCTYALENGFFDEEEEYFQEQNSLHDRRDRGPPRDLSLPVSSLSSSDWILESI

SEQ ID NO: 1030774 - protein, 1005 aa, Homo sapiens
MPLLGAGGQWWPQGDWEPPACPLLPSLGFGSGISQERGLLPRVPQHIWAESGFQALSHTSSFLHDTRDFCLSRPHLTATQSKRCWSQIAPGLCTHCKERTAGCCPHSDPDNRKCSPCLGELRAIPVGGPHTTLLPLHSFSSGELLAGGSEEWVIVGLCFLSMWGSASWGPTLQETPFWGKKIEPQELSGFLEGFLEEGELEQARTLPGFPCCMQPHWPWWQTLPGHGTLPPNISLAQRSDPGSQGHTAILGKAGLVLGMALLTLGLSHPNLALWRSRSEGPITCATQGQLCDSLGADGCSLYLGPLNRPQHTGQVLGSKTPPATTWDFLCEGHWWSLRNRPGQTGSGSESLTLGRRGLQCRPGGWVCVSVCVCVCVCVRARARRYSRVSAARPGWPAGLSFPRSAPRPGPPPPCRCSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 1030775 - protein, 529 aa, Homo sapiens
MALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 1030776 - protein, 593 aa, Homo sapiens
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 1030777 - protein, 642 aa, Homo sapiens
GGAGLPTDGAPRGCPAVPAVPGSARRGRGAHASCLLTLSFGFSQASAADMEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 1030778 - protein, 593 aa, Homo sapiens; identical to SEQ ID NO: 1030776

SEQ ID NO: 1030779 - protein, 261 aa, Homo sapiens
MESGEEYPVLSTQHQHVVDRMTVNICKMIRWFPRERRDNSKQGEGASSVTRSSLRLAFASLYVLRVRLLHYMSEVMLVARTLKGEKWIRETLYEMAAVSYMKLCDSFRKRPEEQIAGGSFQAKDCECEWCTLPLAKKKIRMSLTFRRPKTLRLRRQPRYPRKSTPRRNKLGHYAIIKFPLTTESAVKKIEENNTLVFTVDVKANKHQIRQAVKKLYDSDVAKVTTLICPDKENKAYVRLAPDYDAFDVVTKLGSPKLSPAG

SEQ ID NO: 1030780 - protein, 121 aa, Homo sapiens [sequence omitted]

SEQ ID NO: 1030781 - protein, 204 aa, Homo sapiens
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKRGRTRTITT

SEQ ID NO: 1030782 - protein, 91 aa, Homo sapiens
MLEMLEYNHYQVQTHLENPTKYHIQQAQRQQVKQYLSTTLANKHANQVLSLPCPNQPGDHVMPPVPGSSAPNSPMAMLTLNSNCEKEFMKQ

SEQ ID NO: 1030783 - protein, 91 aa, Homo sapiens; identical to SEQ ID NO: 1030782

SEQ ID NO: 1030784 - protein, 127 aa, Homo sapiens
MDVFKKGFSIAKEGVVDAVEKTKQGVTEAAEKTKEGVMYVGAKTKENVVQSVTSVAEKTKEQANAVSEAVVSSVNTVATKTVEEAENIAVTSGVVRKEDLRPSAPQQEGEASKEKEEVAEEAQSGGD

SEQ ID NO: 1030785 - protein, 128 aa, Homo sapiens
TGTARNFGMGRRALQAWGFQAWDTWAFLGQESTQVNLQLRSQMRPIPGRSALRVEALIGVNRRHRGQPLRQHSSQLKPAARREIQLRPACSSTTLHTHHGCLQEGLLHRQGGRGGCGGKDQAGGDGSS

SEQ ID NO: 1030786 - protein, 346 aa, Homo sapiens
TGTARNFGMGRRALQAWGFQAWDTWAFLGQESTQVNLQLRSQMRPIPGRSALRVEALIGVKGGIGDSRCGSTRASSSPQLAGRSSSVLPAAAQPCTPTMDVFKKGFSIAKEGVVGAVEKTKQGVTEAAEKTKEGVMYVGAKTKENVVQSVTSGEKPQGQGTHGGEDPWGSCILVLGLKPRVLPYPQLGSQALQTPADHKAKLGWASPYPQQHQRCPGVRGSRGGSQQGQALSSWEGAASLTQQACLGAGAGVEASQCPPIVAEKTKEQANAVSEAVVSSVNTVATKTVEEAENIAVTSGVVRKVSPGPHPAQFLSLGPERLVGGGGITPIQTPGNNTGGCGWLQIQ

SEQ ID NO: 1030787 - protein, 205 aa, Homo sapiens
MARNFGMGRRALQAWGFQAWDTWAFLGQESTQVNLQLRSQMRPIPGRSALRVEALIGVKGGIGDSRCGSTRASSSPQLAGRSSSVLPAAAQPCTPTMDVFKKGFSIAKEGVVGAVVYVGAKTKENVVQSVTSVAEKTKEQANAVSEAVVSSVNTVATKTVEEAENIAVTSGVVRKEDLRPSAPQQEGEASKEKEEVAEEAQSGGD

SEQ ID NO: 1030788 - protein, 127 aa, Homo sapiens; identical to SEQ ID NO: 1030784

SEQ ID NO: 1030789 - protein, 222 aa, Homo sapiens
MARNFGMGRRALQAWGFQAWDTWAFLGQESTQVNLQLRSQMRPIPGRSALRVEALIGVKGGIGDSRCGSTRASSSPQLAGRSSSVLPAAAQPCTPTMDVFKKGFSIAKEGVVGAVEKTKQGVTEAAEKTKEGVMYVGAKTKENVVQSVTSGLPWGWGWGGGQPVSSHSGREDQGAGQRRERGCGEQRQHCGHQDRGGGGEHRGHLRGGAQGGLEAICPPTGG

SEQ ID NO: 1030790 - protein, 222 aa, Homo sapiens; identical to SEQ ID NO: 1030789

SEQ ID NO: 1030791 - protein, 128 aa, Homo sapiens; identical to SEQ ID NO: 1030785

SEQ ID NO: 1030792 - protein, 123 aa, Homo sapiens
MPYPPTDPTVVQLSVVFVLTAPTTRGRSGLQLHLYVGAKTKENVVQSVTSVAEKTKEQANAVSEAVVSSVNTVATKTVEEAENIAVTSGVVRKEDLRPSAPQQEGEASKEKEEVAEEAQSGGD

SEQ ID NO: 1030793 - protein, 127 aa, Homo sapiens; identical to SEQ ID NO: 1030784

SEQ ID NO: 1030794 - protein, 127 aa, Homo sapiens; identical to SEQ ID NO: 1030784

SEQ ID NO: 1030795 - protein, 217 aa, Homo sapiens
MSSKVSRDTLYEAVREVLHGNQRKRRKFLETVELQISLKNYDPQKDKRFSGTVRLKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 1030796 - protein, 350 aa, Homo sapiens
MSSKVSRDTLYEAVREVLHGNQRKRRKFLETVELQISLKNYDPQKDKRFSGTVRLDRSDPSQASGPPGLPLPVTGSRLSREAGHSRVQRLLGARFRPICIRSRARRGRIPYPVFLKHEGRRGIGLWPEHRTASLEKPGMDAGRIVNASRCKATVGYAERSHDHFTGPLRTQVLGRNLECCPTEKTQALKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 1030797 - protein, 212 aa, Homo sapiens
MDAGRIVNASRCKATVGKHSGPMTTFTGPLRTQVLGRNLECCPTEKTQALKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 1030798 - protein, 231 aa, Homo sapiens
MSSKVSRDTLYEAVREVLHGNQRKRRKFLETVELQISLKNYDPQKDKRFSGTVRWLNVTLLRSLMFSCVVSVGGHMHAHDDCWLEARAIFLASVDIRMASELKPQQEFTNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 1030799 - protein, 217 aa, Homo sapiens; identical to SEQ ID NO: 1030795

SEQ ID NO: 1030800 - protein, 228 aa, Homo sapiens
MSSKVSRDTLYEAVREVLHGNQRKRRKFLETVELQISLKNYDPQKDKRFSGTVRLKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRSVLGCSNKPHCCH

SEQ ID NO: 1030801 - protein, 227 aa, Homo sapiens
MSSKVSRDTLYEAVREVLHGNQRKRRKFLETVELQISLKNYDPQKDKRFSGTVRLKSTPRPKFSVCVLGDQQHCDEAKAVDIPHMDIEALKKLNKDIEALKNLTKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 1030802 - protein, 74 aa, Homo sapiens
MVAAKKTKKSLESINSRLPLVMKSGKYVLGYQQTLKMIRPGQAKLVILANNCPALRKSEIEYYAIMALSRDPLT

SEQ ID NO: 1030803 - protein, 86 aa, Homo sapiens
MVAAKKTKKSLESINSRLPLVMKSGKYVLGYQQTLKMIRPGQAKLVILANNCPALRKSEIEYYAIETSKTRAIETSKTSAIETSKT

SEQ ID NO: 1030804 - protein, 128 aa, Homo sapiens
MVAAKKTKKSLESINSRLPLVMKSGKYVLGYQQTLKMIRPGQAKLVILANNCPALRKSEIEYYAMLAKTGVHHYSGIILTGHSMRKILQSVTLAIIDPGDSDIIRSMPEQAGGKDRTFSSYNNFTWKP

SEQ ID NO: 1030805 - protein, 52 aa, Homo sapiens
MVAAKKTKKSLESINSRLPLVMKSGKYVPGVKTRLFKSYSNKAKPKFGAYSL

SEQ ID NO: 1030806 - protein, 77 aa, Homo sapiens
MVAAKKTKKSLESINSRLPLVMKSGKYVLGYQQTLKMIRPGQAKLVILANNCPALRKSEIEYYAMLAYRGYKLELYT

SEQ ID NO: 1030807 - protein, 145 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTH

SEQ ID NO: 1030808 - protein, 349 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTHKCTTLDTHTHTYTTTPPPTGGGERTNRRITPKREATPTMISDVHTPTRLPGFKQRVGPPNKRAEQQHTLTTAKSRGGTSVMLITNHAASRSTRQNKPEVNQHDGHTLLSRNTHHPTHQGAGQHPHTAGDHKKPPPNSNDTNDDAPKETTPTTTIHRDHQQASPNTPSGPINHDGAPRQPRCATSRIKPACTNSTYTPTRAAPSE

SEQ ID NO: 1030809 - protein, 127 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKN

SEQ ID NO: 1030810 - protein, 117 aa, Homo sapiens
AAATTTTSLLLLNSRPLTKNAESNAELKGLDVDSLVIEHIQVNKAPKMRRRTYRAHGRINPYMSSPCHIEMILTEKEQIVPKPEEEVAQKKKISQKKLKKQKLMARELNSGHSTHKC

SEQ ID NO: 1030811 - protein, 145 aa, Homo sapiens; identical to SEQ ID NO: 1030807

SEQ ID NO: 1030812 - protein, 145 aa, Homo sapiens; identical to SEQ ID NO: 1030807

SEQ ID NO: 1030813 - protein, 145 aa, Homo sapiens; identical to SEQ ID NO: 1030807

SEQ ID NO: 1030814 - protein, 145 aa, Homo sapiens; identical to SEQ ID NO: 1030807

SEQ ID NO: 1030815 - protein, 145 aa, Homo sapiens; identical to SEQ ID NO: 1030807

SEQ ID NO: 1030816 - protein, 145 aa, Homo sapiens; identical to SEQ ID NO: 1030807

SEQ ID NO: 1030817 - protein, 145 aa, Homo sapiens; identical to SEQ ID NO: 1030807

SEQ ID NO: 1030818 - protein, 145 aa, Homo sapiens; identical to SEQ ID NO: 1030807

SEQ ID NO: 1030819 - protein, 148 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTHLRV

SEQ ID NO: 1030820 - protein, 161 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTHKCRAAEFQHNKDEHII

SEQ ID NO: 1030821 - protein, 197 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTHKINVINRKKKHTKQKTKTKNTTKKKKNKHRARLIWGGGKKGKQKGGGGKRGY

SEQ ID NO: 1030822 - protein, 145 aa, Homo sapiens; identical to SEQ ID NO: 1030807

SEQ ID NO: 1030823 - protein, 137 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARE

SEQ ID NO: 1030824 - protein, 197 aa, Homo sapiens; identical to SEQ ID NO: 1030821

SEQ ID NO: 1030825 - protein, 205 aa, Homo sapiens
MVRYSLDPENPTKSCKSRGSNLRVHFKNTRETAQAIKGMHIRKATKYLKDVTLQKQCVPFRRYNGGVGRCAQAKQWAMGLDRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTH

SEQ ID NO: 1030826 - protein, 137 aa, Homo sapiens; identical to SEQ ID NO: 1030823

SEQ ID NO: 1030827 - protein, 123 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRSSSEQFHLGAYVELLRPKWNCSAGEEKRTKTSKALLYFLKVL

SEQ ID NO: 1030828 - protein, 137 aa, Homo sapiens; identical to SEQ ID NO: 1030823

SEQ ID NO: 1030829 - protein, 80 aa, Homo sapiens
YYYYYYYISGRSIQVNKAPEMRRRTYRAHGRINPYMSSPCHIEMILTEKEQIVPKPEEEVAQKKKISQKKLKKQKLMARE

SEQ ID NO: 1030830 - protein, 145 aa, Homo sapiens; identical to SEQ ID NO: 1030807

SEQ ID NO: 1030831 - protein, 145 aa, Homo sapiens; identical to SEQ ID NO: 1030807

SEQ ID NO: 1030832 - protein, 147 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTHKC

SEQ ID NO: 1030833 - protein, 145 aa, Homo sapiens; identical to SEQ ID NO: 1030807

SEQ ID NO: 1030834 - protein, 145 aa, Homo sapiens; identical to SEQ ID NO: 1030807

SEQ ID NO: 1030835 - protein, 145 aa, Homo sapiens; identical to SEQ ID NO: 1030807

SEQ ID NO: 1030836 - protein, 145 aa, Homo sapiens; identical to SEQ ID NO: 1030807

SEQ ID NO: 1030837 - protein, 145 aa, Homo sapiens; identical to SEQ ID NO: 1030807

SEQ ID NO: 1030838 - protein, 145 aa, Homo sapiens; identical to SEQ ID NO: 1030807

SEQ ID NO: 1030839 - protein, 348 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTHKCTTLDTHTHPYTTTPPPTGGGERTNRRITPKREATPTMISTSTPQRVFLDSNKGWGPTNKRAEQQHTLTTAKSRGGTSVMLITNHAASRSTRQNKPGEPTRRTHPVEQKHTPPNTPGGGAAPTHGGRPQETTAEQQRYYRRRTKGDHTNNNHPPRPPTGEPKHTQRTHQSRRRPKTAAVRHKPNQASMHKQHIHPNKSRALR

SEQ ID NO: 1030840 - protein, 147 aa, Homo sapiens; identical to SEQ ID NO: 1030832

SEQ ID NO: 1030841 - protein, 152 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARELNSGHSTHKKKKKKK

SEQ ID NO: 1030842 - protein, 127 aa, Homo sapiens; identical to SEQ ID NO: 1030809

SEQ ID NO: 1030843 - protein, 105 aa, Homo sapiens
MSLYRNSVYHSDVTMVELAGVRRPSNGQWGWTQGRWPKKSAEFLLHMLKNAESNAELKGLDVDSLVIEHIQVNKAPKMRRRTYRAHGRINPYMSSPCHIEMILLV

SEQ ID NO: 1030844 - protein, 137 aa, Homo sapiens; identical to SEQ ID NO: 1030823

SEQ ID NO: 1030845 - protein, 137 aa, Homo sapiens; identical to SEQ ID NO: 1030823

SEQ ID NO: 1030846 - protein, 112 aa, Homo sapiens
MSLYRNSVYHSDVTMVELAGVRRPSNGQWGWTQGRWPKKSAEFLLHMLTRPFLCAPSLSVLRLGCMSVLFAHTLSAPPPPHLLPSPPPRPPASRHRTAARSTASRVPSRPPS

SEQ ID NO: 1030847 - protein, 145 aa, Homo sapiens; identical to SEQ ID NO: 1030807

SEQ ID NO: 1030848 - protein, 145 aa, Homo sapiens; identical to SEQ ID NO: 1030807

SEQ ID NO: 1030849 - protein, 999 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030850 - protein, 1013 aa, Homo sapiens
MGWKPSEARGQSQSFQASGLQPRSLKAARRATGRPDRSRAARPTTDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030851 - protein, 927 aa, Homo sapiens
MGWKPSEARGQSQSFQASGLQPRSLKAARRATGRPDRSRAAPPNMDPDPQAGVQGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030852 - protein, 1017 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNAALMWPPVCCSLMLLVLPCVLCTGSFNHVIPMNVTCQLALVCLLHDGGPSLARVVAGALCVSAAVTSTCPTPTRTRPCTPPSRRALEPAALSRSSRRCQTSMLPPPTARFHPAAPCLPQGSRASCEKDSGSGAAAGGRQEGGRLHGAASGCPQQPPEVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030853 - protein, 1019 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSAARPCPFSAIHRDRSEFELAGRQRPDCFGPRLVYNEDLAL

SEQ ID NO: 1030854 - protein, 822 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTRYCEKDSGSGAAAGGRQEGGRLHGAASGCPQQPPLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRVRAQDEEVHQVPGGRQQETAPRRL

SEQ ID NO: 1030855 - protein, 142 aa, Homo sapiens
PGPAGAGVVRWGRRPGRVGCGARQALWPGLAAAEQSGPVGGLERRDRPTDGLAGGPAPPSGAGGTETSGQVGVGRVGSPARLEASPKVSRHQGCSPGASRRPGGRLDGRTGELLIVRGLIVCTWLSHFGAPWKPRQRGCVCV

SEQ ID NO: 1030856 - protein, 178 aa, Homo sapiens
PGPAGAGVVRWGRRPGRVGCGARQALWPGLAAAEQSGPVGGLERRDRPTDGLAGGPAPPSGAGGTETSGQVGVGRVGSPARLEASPKVSRHQGCSPGASRRPGGRLDGRTGQVSPCWPPRLRASSHSVGLISLGHLGCPSALAGATPWPVACHTQRHFGVIRHSWRCKEEGSLMSSSM

SEQ ID NO: 1030857 - protein, 963 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAGHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030858 - protein, 1087 aa, Homo sapiens
PGPAGAGVVRWGRRPGRVGCGARQALWPGLAAAEQSGPVGGLERRDRPTDGLAGGPAPPSGAGGTETSGQVGVGRVGSPARLEASPKVSRHQGCSPGASRRPGGRLDGRTGPEQPGPPRTPLPTVSRAAPPNMDPDPQAGVQVGMRVVRGVDWKWGQQDGGEGGVGTVVELGRHGSPSTPDRTVVVQWDQGTRTNYRAGYQGAHDLLLYDKYKIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030859 - protein, 1030 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTRCECGVGTQLQPASCCAAWGQSHGPRPTSLLHRAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030860 - protein, 1032 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRTWGAGCWGCQVPGDASLGPAPAPALTGVCPAAQLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030861 - protein, 862 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRVRAQDEEVHQVPGGRQQETAPRRL

SEQ ID NO: 1030862 - protein, 997 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMFFFFFFFFDSHIRLVFQCGHGACAPCGSALSACPICRQPIRDRIQIFV

SEQ ID NO: 1030863 - protein, 518 aa, Homo sapiens
PGRGPAGLSLCVLGSGLAGLSLCVSHRARRPPSPTSSPVRNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTRCECGVGTQLQPASCCAAWGQSHGPRPTSLLHRAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030864 - protein, 170 aa, Homo sapiens
GPGEDGPGLAVISAVSRSGVTRNRRIGPHWWSRQELTYGAASAGQCQRARRRSPSPRLYGNRVRLQDRHGAGARRLSRFWNLAAPNARVGDAGRSRVTHFRCLPCPSPCGGRGHGGGAPAGGGPWAPALRVPQFPAAALLSARWPRRAWEPEAVPESLLGHWRDAGRPLG

SEQ ID NO: 1030865 - protein, 1066 aa, Homo sapiens
PGPAGAGVVRWGRRPGRVGCGARQALWPGLAAAEQSGPVGGLERRDRPTDGLAGGPAPPSGAGGTETSGQVGVGRVGSPARLEASPKVSRHQGCSPGASRRPGGRLDGRTGPEQPRPTWTQTPRRACRWACGWCAAWTGSGASRTAARAAWARWWSLAATAAPRHPTAQWSCSGTRARAPTTAPATRARTTCCCVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030866 - protein, 857 aa, Homo sapiens
SSVSFICEPSCSVTLSPRQGLPRIPLRGIFQGAKVVRGPDWEWGSQDGEWRQRGGVRAGLWLAHGSALACWGGLFSPGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQVSPCCTMPPSRVTLLAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030867 - protein, 363 aa, Homo sapiens
MLPPPTARFHPAAPCLPQGSRASCEKDSGSGAAAGGRQEGGRLHGAASGCPQQPPEVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 1030868 - protein, 156 aa, Homo sapiens
MGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCLSACPICRQPIRDRIQIFV

SEQ ID NO: 1030869 - protein, 112 aa, Homo sapiens
MSTASTPRAPTTGTADLQLERINVYYNEATGGKYCAPAPCSWIWSPAPWTPCARGPSGRSSGRTTSFSVRVVLGTTGPRGTTQNGAELVDSVLDVVTNTEAESCDCLQGFPS

SEQ ID NO: 1030870 - protein, 112 aa, Homo sapiens
MSTASTPRAPTTGTADLQLERINVYYNEATGGKYCAPAPCSWIWSPAPWTPCARGPSGRSSGRTTSFSVRVVLGTTGPRGTTQNGAELVDSVLDVVTNTEAESCDCLQGFPC

SEQ ID NO: 1030871 - protein, 112 aa, Homo sapiens; identical to SEQ ID NO: 1030869

SEQ ID NO: 1030872 - protein, 445 aa, Homo sapiens
MREIVHLQAGQCGNQIGAKFWEVISDEHGIDPTGTYHGDSDLQLERINVYYNEATGGKYVPRAVLVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEVA

SEQ ID NO: 1030873 - protein, 166 aa, Homo sapiens
MFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEGGLEPSVTGESREAV

SEQ ID NO: 1030874 - protein, 112 aa, Homo sapiens; identical to SEQ ID NO: 1030870

SEQ ID NO: 1030875 - protein, 158 aa, Homo sapiens
MFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 1030876 - protein, 144 aa, Homo sapiens
MFDAKNMMAACDPRHGRYLTVAAVFRGRMSMKEVDEQMLNVQNKNSSYFVEWIPNNVKTAVCDIPPRGLKMSATFIGTGRPSGASSAFEQSRQVGARLWQVPGGGQGSEATRAGVRPVTGGRGQGTGRRNRQVARLKLGAHFVD

SEQ ID NO: 1030877 - protein, 184 aa, Homo sapiens
MFDAKNMMAACDPRHGRYLTVAAVFRGRMSMKEVDEQMLTIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATADEQGEFEEEAGRGRGVDAPARRVRESGGGKRGGGGLPGTKTQGKER

SEQ ID NO: 1030878 - protein, 126 aa, Homo sapiens
MTLGGHHHLACASQGQLNAGPAEAGLVNMVPFPRLHFFMPGFAPLDQPGQPAVPGADRARAFLHWYTGEGMDEMEFTEAESNMNDLVSEYQQYQDATAEEEGEFEEEAEEEGGLEPSVTGESREAV

SEQ ID NO: 1030879 - protein, 112 aa, Homo sapiens; identical to SEQ ID NO: 1030870

SEQ ID NO: 1030880 - protein, 112 aa, Homo sapiens; identical to SEQ ID NO: 1030870

SEQ ID NO: 1030881 - protein, 112 aa, Homo sapiens; identical to SEQ ID NO: 1030870

SEQ ID NO: 1030882 - protein, 112 aa, Homo sapiens; identical to SEQ ID NO: 1030870

SEQ ID NO: 1030883 - protein, 306 aa, Homo sapiens
MEQTATTAADAPPQPPTTTRATTTHGSTHTPKRHTTRHPPTPKAPTNHDQHARATRPGETDPQQENKQRARKHTHRQRHQRRRRTNLSHTTQTRNDRTPTHNNETPSKSRTHPKERSKNKRHNHGNHKMHKRGQSRTGHTTTAGKKHKQYPKENQRNITRQGARKENQNRAETDQTEGPRNPRRTTPGTQTTREKHHKTSTRETTNRPEPYKNQSHNKENKETTTHTTKRQQKQTQTKKDEHNKHRTKNNKDTRDKGARKQKNRREQKPSHEEGGRDEEREQGSSYKKIETRKEYGDPTPQQKTEE

SEQ ID NO: 1030884 - protein, 166 aa, Homo sapiens; identical to SEQ ID NO: 1030873

SEQ ID NO: 1030885 - protein, 191 aa, Homo sapiens
MVPFPRLHFFMPGFAPLTVPELTQQMFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATAEEEGEFEEEAEEEGGLEPSVTGESREAV

SEQ ID NO: 1030886 - protein, 112 aa, Homo sapiens; identical to SEQ ID NO: 1030870

SEQ ID NO: 1030887 - protein, 112 aa, Homo sapiens; identical to SEQ ID NO: 1030870

SEQ ID NO: 1030888 - protein, 166 aa, Homo sapiens; identical to SEQ ID NO: 1030873

SEQ ID NO: 1030889 - protein, 166 aa, Homo sapiens; identical to SEQ ID NO: 1030873

SEQ ID NO: 1030890 - protein, 112 aa, Homo sapiens; identical to SEQ ID NO: 1030870

SEQ ID NO: 1030891 - protein, 166 aa, Homo sapiens; identical to SEQ ID NO: 1030873

SEQ ID NO: 1030892 - protein, 153 aa, Homo sapiens
MFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 1030893 - protein, 166 aa, Homo sapiens; identical to SEQ ID NO: 1030873

SEQ ID NO: 1030894 - protein, 158 aa, Homo sapiens
MFDAKNMMAACDPRHGRYLTVAAVFRGRMSMKEVDEQMLTIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 1030895 - protein, 165 aa, Homo sapiens
MFDAKNMMAACDPRHGRYLTVAAVFRGRMSMKEVDEQMLNVQNKNSSYFVEWIPNNVKTAVCDIPPRGLKMSATFIGNSTAIQELFKRISEQFTAMFRRKAFLHCVTMANISESKRATATVVKDDSLRGPEYAIMICTWWSEYQQYQRCPQSVRYGWSEFRGGSA

SEQ ID NO: 1030896 - protein, 166 aa, Homo sapiens; identical to SEQ ID NO: 1030873

SEQ ID NO: 1030897 - protein, 112 aa, Homo sapiens; identical to SEQ ID NO: 1030870

SEQ ID NO: 1030898 - protein, 144 aa, Homo sapiens; identical to SEQ ID NO: 1030876

SEQ ID NO: 1030899 - protein, 166 aa, Homo sapiens; identical to SEQ ID NO: 1030873

SEQ ID NO: 1030900 - protein, 166 aa, Homo sapiens; identical to SEQ ID NO: 1030873

SEQ ID NO: 1030901 - protein, 112 aa, Homo sapiens; identical to SEQ ID NO: 1030870

SEQ ID NO: 1030902 - protein, 107 aa, Homo sapiens
MNHRLGWWFAFAQKCQTQWVEALQTPTLSVHQTRKKQTPRRDLTLQYTGEGMDEMEFTEAESNMNDLVSEYQQYQDATAEEEGEFEEEAEEEGGLEPSVTGESREAV

SEQ ID NO: 1030903 - protein, 104 aa, Homo sapiens
MSTASTPRAPTTGTADLQLERINVYYNEATGGKYCAPAPCSWIWSPAPWTPCARGPSGRSSGRTTSFSVSRGWGLGGGSKVKGLLQGHRRGNCAAGAPGRPPLL

SEQ ID NO: 1030904 - protein, 445 aa, Homo sapiens; identical to SEQ ID NO: 1030872

SEQ ID NO: 1030905 - protein, 445 aa, Homo sapiens; identical to SEQ ID NO: 1030872

SEQ ID NO: 1030906 - protein, 327 aa, Homo sapiens
MAVPAKKRKMNFSEREVEIIVEELELKKHLLVNHFNAGVPLAAKSAAWHGILRRVNAVATCRRELPEVKKKWSDLKTEVRRKVAQVRAAVEGGEAPGPTEEDGAGGPGTGGGSGGGGPAVAPVLLTPMQQRICNLLGEATIISLPSTTEIHPVALGPSATAAAATVTLTQIPTETTYHTLEEGVVEYCTAEAPPPLPPETPVDMMAQHADTSVKPQALKSRIALNSAKLIQEQRVTNLHVKEIAQHLEQQNDLLQMIRRSQEVQACAQERQAQAMEGTQAALSVLIQVLRPMIKDFRRYLQSNTANPAPASDPGQVAQNGQPDSIIQ

SEQ ID NO: 1030907 - protein, 206 aa, Homo sapiens
GTRPHRTFHRARLVVDSQAIFVEKIDGNNTAQVRQLILDSVFSVGDLSSVPTETTYHTLEEGVVEYCTAEAPPPLPPETPVDMMAQHADTSVKPQALKSRIALNSAKLIQEQRVTNLHVKEIAQHLEQQNDLLQMIRRSQEVQACAQERQAQAMEGTQAALSVLIQVLRPMIKDFRRYLQSNTANPAPASDPGQVAQNGQPDSIIQ

SEQ ID NO: 1030908 - protein, 185 aa, Homo sapiens
RQAGGRGGFRDAPPLRAPLRRPRPGAPEVPTETTYHTLEEGVVEYCTAEAPPPLPPETPVDMMAQHADTSVKPQALKSRIALNSAKLIQEQRVTNLHVKEIAQHLEQQNDLLQMIRRSQEVQACAQERQAQAMEGTQAALSVLIQVLRPMIKDFRRYLQSNTANPAPASDPGQVAQNGQPDSIIQ

SEQ ID NO: 1030909 - protein, 327 aa, Homo sapiens; identical to SEQ ID NO: 1030906

SEQ ID NO: 1030910 - protein, 172 aa, Homo sapiens
MAVPAKKRKMNFSEREVEIIVEELELKKHLLVNHFNAGVPLAAKSAAWHGILRRVNAVATCRRELPEVKKKWSDLKTEVRRKVAQVRAAVEGGEAPGPTEEDGAGGPGTGGGSGGGGPAVAPVLLTPMQQRICNLLGEATIISLPSTTEIHPVALGPSATAAAATVTLTQSE

SEQ ID NO: 1030911 - protein, 327 aa, Homo sapiens; identical to SEQ ID NO: 1030906

SEQ ID NO: 1030912 - protein, 182 aa, Homo sapiens
MPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 1030913 - protein, 562 aa, Homo sapiens
GAGEEWRYLSEESAFEEVALLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAITHSVSTSNVIGFTKHVYVQRLNSTGGRSQYSWFQSVRHSAFRASFSEILEGNTDFSNFKKVLSKSSLTFVKN

SEQ ID NO: 1030914 - protein, 257 aa, Homo sapiens
GAGEEWRYLSEESAFEEVALLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQILI

SEQ ID NO: 1030915 - protein, 182 aa, Homo sapiens; identical to SEQ ID NO: 1030912

SEQ ID NO: 1030916 - protein, 518 aa, Homo sapiens
GAGEEWRYLSEESAFEEVALLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 1030917 - protein, 385 aa, Homo sapiens
GAGEEWRYLSEESAFEEVALLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEGMPVYILGYIKIVYIHCRFNLLHFGFFKLVNYL

SEQ ID NO: 1030918 - protein, 182 aa, Homo sapiens; identical to SEQ ID NO: 1030912

SEQ ID NO: 1030919 - protein, 182 aa, Homo sapiens; identical to SEQ ID NO: 1030912

SEQ ID NO: 1030920 - protein, 482 aa, Homo sapiens
GAGEEWRYLSEESAFEEVALLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVKEYE

SEQ ID NO: 1030921 - protein, 245 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGRRGGWCSTG

SEQ ID NO: 1030922 - protein, 243 aa, Homo sapiens
MAPNGLPNHIMAPVWKCLHLTKDFREQKHSYWEFAEWIPLAWKWHLLSELEAAPYLPQEEKSPLFSVQREGLPEDGTLYRINRFSSITAHPERWDVSFFTGGPLWALDWCPVPEGAGASQYVALFSSPDMNETHPLSQLHSGPGLLQLWGLGTLQQESCPGNRAHFVYGMLVTTDASGDLKFCPVEHGELPGTPRQAPLLARLGLLGSGLDQNGKRSAISALTPSGGTDWSENNKMKMMACSI

SEQ ID NO: 1030923 - protein, 270 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVGISGFSQELGLRILKRLAALGLGLRGPRGEPYITGKVELVLPCGRVVCARSRFFPGALTGHVGSDHYTLCAEAWLWRTRG

SEQ ID NO: 1030924 - protein, 304 aa, Homo sapiens
TGYEAGMLSDRRRIFELRLPEGLWRGLSVRQNPLKSLLKHKVLAPSRIADSGQPFWGVLMDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGRRGGWCSTG

SEQ ID NO: 1030925 - protein, 298 aa, Homo sapiens
MDTCGVGYVALGEAGPVGNMTVVDSPGQEVLNQLDVKTSSEMTSAEASVEMSLPTPLPGFEDSPDQRRLPPEQESLSRLEQPDLSSEMSKVSKPRASKPGRKRGGRTRKGPKRPQQPNPPSAPLVPGLLDQSNPLSTPMPKKRGRKSKAELLLLKLSKDLDRPESQSPKRPPEDFETPSGERPRRRAAQVALLYLQELAEELSTALPAPVSCPEGPKVSSPTKPKKIRQPAACPGGRRGGGPPDETSQVSHKWKWAREALTSGCEPRFWKTREPGNIAGGPGNSGATERSEDTTPRRR

SEQ ID NO: 1030926 - protein, 243 aa, Homo sapiens; identical to SEQ ID NO: 1030922

SEQ ID NO: 1030927 - protein, 160 aa, Homo sapiens
MPGFVDLILGRISEENRKNPDGGLLGALGSFFFLPPLAGPFISRSQCTLSVFAISSNLDFSFPDIVFHLSEHFLENSGLLSPSSAPWLAFIILDIRAPETRAQHESPALPRLPFEHLRALQGPRPGNLRVLGYEPCQPPVADAAAVLGRSHLAALLATAA

SEQ ID NO: 1030928 - protein, 175 aa, Homo sapiens
MGRAQSLSDSSAVSTPSCPGVAWPGGIVSHSRWTRAEWVRDGTSPVDSSSATPPHLPGEEQHTVRTNGETSSEKIQSQGWAWMWASRDHLPEPDLGDAAPPGSPSSFWTSGLPRQERSTSRQRSRGSPSSTCVPYKVHALATFECSATSHASRLWQTLQQFWADHISRPFSPRRP

SEQ ID NO: 1030929 - protein, 138 aa, Homo sapiens
MVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 1030930 - protein, 113 aa, Homo sapiens
MIIYRDLISHDEMFSDIYKIREIADGLCLEVEGKMVSRTEGNIDDSLIGGNASAEGPEGEGTESTVITGVDIVMNHLPLHLQAQPVRDLPDLVDVGEHLIVADEVPVDNHDGD

SEQ ID NO: 1030931 - protein, 196 aa, Homo sapiens
MIIYRDLISHDEMFSDIYKIREIADGLCLEVEGKMSRSGLRVGEIRAERDSRYSSASHRHEVCANPPRTIILAEETLIIRALRINIEKLEAELILEIGPHDSRDPIHSSRGMYRGHDCFQALGSLEIHSRDRTWYTTLHKRRHQQCHETWATHSSHGTPRYELPGQHRTTSYSKVYEHGREENHRGTQTFNATKNW

SEQ ID NO: 1030932 - protein, 172 aa, Homo sapiens
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 1030933 - protein, 169 aa, Homo sapiens
SGAGSLGGSLGGTLEALRVAPGSGAWHVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 1030934 - protein, 114 aa, Homo sapiens
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKWQ

SEQ ID NO: 1030935 - protein, 172 aa, Homo sapiens; identical to SEQ ID NO: 1030932

SEQ ID NO: 1030936 - protein, 172 aa, Homo sapiens; identical to SEQ ID NO: 1030932

SEQ ID NO: 1030937 - protein, 145 aa, Homo sapiens
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDDS

SEQ ID NO: 1030938 - protein, 273 aa, Homo sapiens
MSILCSQVQGDLSVQRGGIDSRRGAQQQPHRLQPALPGCVVQRAHAIAVLDVNSGLSLKQQGYELQAAPQSSVVEGRESISILVVHVEPLCGAQELCLCGLDLRHQFLHTGHISILDGEDQVLFTTHTGSWAELYTQESRAKAGNGSKLGRQGASHSPLEGSRFRGSKSGVPGSGLLVRYRGILPKVLRELPPHEGKLIFEGVKATWKSGWISACGFRQLQDGLGLGTPIFPAWLWNTSAHPESSQHSLGPQAAAVHWSQGSLPPPAGSGCLL

SEQ ID NO: 1030939 - protein, 272 aa, Homo sapiens
HTLSCLRLFSPLLSLSLFTLPASREVLEVLAADCLWLRLWPMLFKQAELWMPHQGKGNKGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDSTSWNPENFPLPSTL

SEQ ID NO: 1030940 - protein, 1356 aa, Homo sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 1030941 - protein, 1388 aa, Homo sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPSGEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTGERAPWEGVDDGGKGAPLWKSDPHIAPPSPVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 1030942 - protein, 1334 aa, Homo sapiens
MVLMSSRMCLVEALGVPSCSLVPMLFSAALSAAARDELVCSSLCWAWPGPTVPVLSGRGGGTGRGPSRGASLGPENASWVQATDTGLGAVPAPGTLRRAAGAAGGSVSPFHRLAAELSRPGPGQGGTGGCMAGLGARGVGTPWAGRLLGSGWGRLEAGGDSPGVGEGSGAAGPGVALATPKASSAVCSGSLSRHLGLRLTVSDSVRLKSRPGGTGVSRGGGPAGFGRCLMVRFPSSANGSPSPELPRDGGVPSGPGSSSSVSDAGPAGAGGPGGSEGPAGSLSVRLRGPVAPSLGPGLPSSGGGSGLGPETELRRLGGGGGGPLRRARRAKDWLRGVPRAGVGVTLGLVRTRALRPGRRVRVAYCLGCCPLALRPPPQHPPLWARRLRLWDRRLGRGGSGGVAGGPAKEEKAQGAPGGGPGAGLEGEPWGYIKTYGGGPWPGSEEQSLGGRSVPSGRFLSWGGLGSPPLGCGAGCSCEWPDPRERAPMLSWLGERAGGRGSGSGPPPAMAACSSGLSSLPWKVRSRGPAVAGPSPFSSPSMAISSGPLASLAPAFAEGLPLQQAPPKLRQPLHPQHELLLMPELVDPNLLQLLPGEVGHQPHGVVAAAHQLLVVLWQPQCTQPLQQVRWDVAGQPLGDAELSDLWGDLLPVPRLGHPDGRQVLRCHAADGRHIIAGLQKVGSVALQLELAEPVMNGLRVLPLQQLFWPHVLGEDLLPRAAVGQRAVAQVVCQGRRVESWQHLVLSSRGQWLGVLNQEARAMAISALRALPAAGTADAAHAALTAHTIPVTCWAVWAEAHPRKLAVGKRVRGFFGRRLRCPGEAWAQGGGCGGEAGCRDAHPLADHLDNARGEVAYAVCAPLALVDVALPAAVGMLFYTVMTSPARTLRAVGSWRFQKSLSARTFRIPEASRSELLDFPAGLGGGELIHYVQRRLVIRIPDVHVHTSLQKQPHHLGLAIQCGLVERRTRLGLAVDLDPSSQELPDDFSVAILGSQVQGRGVVGVTRVFGLTLQQCHTEVAVQKQLGHLESAKFTGQVQGRLLGLVDQAWVGLMLEEHFCHLIMSILCSQVQGDLSVQRGGIDSRRGAQQQPHRLQPALPGCVVQRAHAIAVLDVNSGLSLKQQGYELQAAPQSSVVEGRESISILVVHVEPLCGAQELCLCGLDLRHQFLHTGHISILDGEDQVLFTTHTGSWAELYTQESRAKAGNGSKLGRQGASHSPLEGSRFRGSKSGVPGSGLLVRYRGILPKVLRELPPHEGKLIFEGVKATWKSGWISACGFRQLQDGLGLGTPIFPAWLWNTSAHPESSQHSLGPQAAAVHWSQGSLPPPAGSGCLL

SEQ ID NO: 1030943 - protein, 1356 aa, Homo sapiens; identical to SEQ ID NO: 1030940

SEQ ID NO: 1030944 - protein, 363 aa, Homo sapiens
MVLMSSRMCLVEALGVPSCSLVPMLFSAALSAAARDELVCSSLCWAWPGPTVPVLSGRGGGTGRGPSRGASLGPENASWVQATDTGLGAVPAPGTLRRAAGAAGGSVSPFHRLAAELSRPGPGQGGTGGCMAGLGARGVGTPWAGRLLGSGWGRLEAGGDSPGVGEGSGAAGPGVALATPKASSAVCSGSLSRHLGLRLTVSDSVRLKSRPGGTGVSRGGGPAGFGRCLMVRFPSSANGSPSPELPRDGGVPSGPGSSSSVSDAGPAGAGGPGGSEGPAGSLSVRLRGPVAPSLGPGLPSSGGGSGLGPETELRRLGGGGGGPLRRARRAKDWLRGVPRAGVGVTLGLVRTRALRPGRRVRVA

SEQ ID NO: 1030945 - protein, 562 aa, Homo sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPSGEPHERDALLAGSLNNTLHLSNEQERGDWPGEAPKPPEPYSHHKAHGRSKHPSGSNVSFSRDTEGGEEEPSKTQPGMESDPYEAEDFVCDYHLVGPWTRP

SEQ ID NO: 1030946 - protein, 577 aa, Homo sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPSGEPHERDALLAGSLNNTLHLSNEQERGDWPGEAPKPPEPYSHHKAHGRSKHPSGSNVSFSRDTEGGEEEPSKVTGGGGTGQPHPRPQAVLASLASLASQGLKEQASLPSVPAPPG

SEQ ID NO: 1030947 - protein, 432 aa, Homo sapiens
PFLGHPGADSGWTAVEGMSAPPACPPSSGLFLPGSEDLASCSWAFSVLQSLDGHQLRTLGQPAPAFAEGLPLQQAPPKLRQPLHPQHELLLMPELVDPNLLQLLPGEVGHQPHGVVASCSPAACGTVAAPVHTCHSSRSVWKSTVLRTPASQPPPPARGEKGTAEATAEGDSTCPTPQPPLMAHWDVAGQPLGDAELSDLWGDLLPVPRLGHPDGRQVLRCHAADGRHIIAGLQKVGSVALQLELAEPVMNGLRVLPLQQLFWPHVLGEDLLPRAAVGQRAVAQVVCQGRRVESWQHLVLSSRGQWLGVLNQEARAMAISALRALPAAGTADAAHAALTAHTIPVTCWAVWAEAHPRKLAVGKRVRGFFGRRLRCPGEAWAQGGGCGGEAGCRDAHPLADHLDNARGEVAYAVCAPLALVDVALPAAVGMLF

SEQ ID NO: 1030948 - protein, 174 aa, Homo sapiens
MPSLFDKATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTCPWSLWW

SEQ ID NO: 1030949 - protein, 363 aa, Homo sapiens; identical to SEQ ID NO: 1030944

SEQ ID NO: 1030950 - protein, 1278 aa, Homo sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPSGEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVV

SEQ ID NO: 1030951 - protein, 233 aa, Homo sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDTERAGAAGGSVALSPLLPGVRVEGRRGG

SEQ ID NO: 1030952 - protein, 1356 aa, Homo sapiens; identical to SEQ ID NO: 1030940

SEQ ID NO: 1030953 - protein, 1356 aa, Homo sapiens; identical to SEQ ID NO: 1030940

SEQ ID NO: 1030954 - protein, 1356 aa, Homo sapiens; identical to SEQ ID NO: 1030940

SEQ ID NO: 1030955 - protein, 1356 aa, Homo sapiens; identical to SEQ ID NO: 1030940

SEQ ID NO: 1030956 - protein, 1356 aa, Homo sapiens; identical to SEQ ID NO: 1030940

SEQ ID NO: 1030957 - protein, 143 aa, Homo sapiens
MCLLFIYNSGTAKYKAAEAQNFKNELLHSGSLHVCFTRPWYSKVSRSLAAPSEVTSAASGTSAPARPGPGWTPRTSGSRESAAAAAVAGATPAQAAAAPRPSSWALRTSASPRLLRTAASPTPGSCSRPGYGAPCAGGAGKAA

SEQ ID NO: 1030958 - protein, 88 aa, Homo sapiens
SPPVWLPKIQWLKDAQGLPGGGGGDNSGTLRDARHSDLAALYTIVAVFPSPLAAQNASLRLNNSVSRFKLRMAKKNYDLRILERASSQ

SEQ ID NO: 1030959 - protein, 104 aa, Homo sapiens
MEEGKGTVTEGARAGWRGLKDPDRPWTEAGSKETDVKLEPKTVMKMETQIPTLALDSFLLPCHGSSLFPWLTPLASLFFPSSSFFFFFFFLRRSFALVTPAGVQ

SEQ ID NO: 1030960 - protein, 737 aa, Homo sapiens
MLLHRGAAYFEMDHNVDQTGKADIINKTSNTRIPEQRFSEHIKDEKNTEFQQRFILKRDDASMDRDDNQIRVPLQDGRRSKSIEEREEEYQRVRERIFARETGQNGYLNDIRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQERYEPFCRVSSKPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQADILMQGSQCCLHGMRVVFQMLKGQSGLKHGNRGKRQALKSASTEPGDKQMLSWGGVLEVTDLPEGITPYLERGQNFFTAGLYNGGPG

SEQ ID NO: 1030961 - protein, 121 aa, Homo sapiens
PDRSLLSIHRMLLHRGAAYFEMDHNVDQTGKAVIINKTSNTRIPEQRFSEHIKDEKNTEFQQRFILKRDDASMDRDDNQIRVPLQDGRRSKSIEEREEEYQRVRERIFARETGQNGYLNDI

SEQ ID NO: 1030962 - protein, 714 aa, Homo sapiens
MLLHRGAAYFEMDHNVDQTGKADIINKTSNTRIPEQRFSEHIKDEKNTEFQQRFILKRDDASMDRDDNQIRVPLQDGRRSKSIEEREEEYQRVRERIFARETGQNGYLNDIRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQERYEPFCRVSSKPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTEPGDKQMLSWGGVLEVTDLPEGITPYLERGQNFFTAGLYNGGPG

SEQ ID NO: 1030963 - protein, 223 aa, Homo sapiens
MGHCVFENSTGCFVFGCVGGSASFFHMLCCVLPGCPALILFCFYTPAISLDVWLFFPPGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 1030964 - protein, 180 aa, Homo sapiens
MAATGANAEKAESHKGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 1030965 - protein, 109 aa, Homo sapiens
SSEPLDQRLSLPHSILRPRLTAWAAWFPEEAERLLLRAVGSSSGPCEMLDPRHLALMWSLSFAAAVVCVTLLNRLEGDQISSPRNVLSEYQQRPQRLVSYFIKKKLSKA

SEQ ID NO: 1030966 - protein, 319 aa, Homo sapiens
HSPGGLVKAEFLGPLDSAGPGEASELIFFSKFIGNTDVAGLGAPLEDLCYDSALMGVSLLWLQFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 1030967 - protein, 180 aa, Homo sapiens; identical to SEQ ID NO: 1030964

SEQ ID NO: 1030968 - protein, 103 aa, Homo sapiens; identical to SEQ ID NO: 825151

SEQ ID NO: 1030969 - protein, 277 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICTGPASVGGMAATGANAEKAESHKGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 1030970 - protein, 310 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 1030971 - protein, 109 aa, Homo sapiens; identical to SEQ ID NO: 1030965

SEQ ID NO: 1030972 - protein, 310 aa, Homo sapiens; identical to SEQ ID NO: 1030970

SEQ ID NO: 1030973 - protein, 310 aa, Homo sapiens; identical to SEQ ID NO: 1030970

SEQ ID NO: 1030974 - protein, 180 aa, Homo sapiens; identical to SEQ ID NO: 1030964

SEQ ID NO: 1030975 - protein, 232 aa, Homo sapiens
MAATGANAEKAESHNDCPVRLLNPNIAKMKEDILYHFNLTTSRHNFPALFGDVKFVCVGGSPSRMKAGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 1030976 - protein, 117 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICTGPASVGGMAATGANAEKAESHNDAPAE

SEQ ID NO: 1030977 - protein, 173 aa, Homo sapiens
MIPNLYDPLREIGPEAQNSARGAFLARGPVGTHGGAMMVVGTGNPWRSPPSCPCCSLLGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 1030978 - protein, 202 aa, Homo sapiens
MIPNLYDPLREIGPEAQNSARGAFLARGPVGTHGGAMMVVGTGNPWRSPPSCPCCSLLGMQMYSRQLASTEWLTIQGGLLGSGLFVFSLTAFNNLENLVFGKGFQAKIFPEILLCLLLALFASGLIHRVCVTTWYVLDSWVRGVAFRFLALDLTVMVPEFFLPHLPLSLFSLPVFLNLNLDSFLDASVFPRRHQAGRCPLVP

SEQ ID NO: 1030979 - protein, 242 aa, Homo sapiens
MIPNLYDPLREIGPEAQNSARGAFLARGPVGTHGGAMMVVGTGNPWRSPPSCPCCSLLGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTAFNNLENLVFGKGFQAKIFPESLLCLLLALFASGLIHRVCVTTCFIFSMVGLYYINKSSLYQAAAPVLTPAKVTGKSKKRN

SEQ ID NO: 1030980 - protein, 173 aa, Homo sapiens; identical to SEQ ID NO: 1030977

SEQ ID NO: 1030981 - protein, 5179 aa, Homo sapiens
MGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNAVVFKSDGSVLLNQLQVNLPHVTASFSVFRPSSYHIMVSMAIGVRLQVQLAPVMQLFVTLDQASQGQVQGLCGNFNGLEGDDFKTASGLVEATGAGFANTWKAQSTCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 1030982 - protein, 3292 aa, Homo sapiens
QPTPPLPATMGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALDGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 1030983 - protein, 1575 aa, Homo sapiens
THHLNLLLFYDFPLMSLITTMNPLTITTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 1030984 - protein, 3208 aa, Homo sapiens
QPTPPLPATMGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALDGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRCLLYKSPSPESLFPLHHGPVMRI

SEQ ID NO: 1030985 - protein, 2785 aa, Homo sapiens
QPTPPLPATMGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALDGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCAPPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 1030986 - protein, 2529 aa, Homo sapiens
QPTPPLPATMGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALDGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPTLGLTVASPSSAPALQWHLQAPNGLQSWIS

SEQ ID NO: 1030987 - protein, 2931 aa, Homo sapiens
QPTPPLPATMGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALDGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPTPITTTTTVTPTPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 1030988 - protein, 3215 aa, Homo sapiens
QPTPPLPATMGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALDGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCGTFVMYSAKAQALDHSCSCCKEEKTSQREVVLSCPNGGSLTHTYTHIESCQCQDTVCGLPTGTSRRARRSPRHLGSG

SEQ ID NO: 1030989 - protein, 2892 aa, Homo sapiens
QPTPPLPATMGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALDGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTKTTASRPAAAGVGAQPSGEPAVPKH

SEQ ID NO: 1030990 - protein, 717 aa, Homo sapiens
VVALVQDTADKHRGRLGPQACGPDDVVKSGGVGIQAPVVVVCTVLGGAEDDPVVYREWDIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 1030991 - protein, 143 aa, Homo sapiens
MGQCRGLRTARKLRSHRRDQKWHDKQYKKAHLGTALKANPFGGASHAKGIVLEKVGVEAKQPNSAIRKCVRVQLIKNGKKITAFVPNDGCLNFIEENDEVLVAGFGRKGHAVGDIPGVRFKVVKVANVSLLALYKGKKERPRS

SEQ ID NO: 1030992 - protein, 229 aa, Homo sapiens
GTIRAVFGSRHSWAGFWVIEFFVRPTAHFWEGPHIFSRLWRLRSLLGFAWAALGPFLRQHRHRSPSLSALAGEYERPFGGPWGPTRMGKCRGLRTARKLRSHRRDQKWHDKQYKKAHLGTALKANPFGGASHAKGIVLEKVGVEAKQPNSAIRKCVRVQLIKNGKKITAFVPNDGCLNFIEENDEVLVAGFGRKGHAVGDIPGVRFKVVKVANVSLLALYKGKKERPRS

SEQ ID NO: 1030993 - protein, 239 aa, Homo sapiens
GTIRAVFGSRHSWAGFWVIEFFVRPTAHFWEGPHIFSRLWRLRSLLGFAWAALGPFLRQHRHRSPSLSALAGEYERPFGGPWGPTRMGKCRGLRTARKLRSHRRDQKWHDKQYKKAHLGTALKANPFGGASHAKGIVLEKVGVEAKQPNSAIRKCVRVQLIKNGKKITAFVPNDGCLNFIEENDEVLVAGFGRKGHAVGDIPGVRFKVVKVANVSLLALYKGKKERPRSYRYDLVYTRL

SEQ ID NO: 1030994 - protein, 158 aa, Homo sapiens
PAVLLSFAQARGADRMGKCRGLRTARKLRSHRRDQKWHDKQYKKAHLGTALKANPFGGASHAKGIVLEKVGVEAKQPNSAIRKCVRVQLIKNGKKITAFVPNDGCLNFIEENDEVLVAGFGRKGHAVGDIPGVRFKVVKVANVSLLALYKGKKERPRS

SEQ ID NO: 1030995 - protein, 41 aa, Homo sapiens
MEPRGTSTRGGRRKDPLVINHPRAYHRGAEEITDTQGGYDE

SEQ ID NO: 1030996 - protein, 110 aa, Homo sapiens
PAVLLSFAQARGADRMGKCRGLRTARKLRSHRRDQKWHDKQYKKAHLGTALKANPFGGASHAKGIVLEKVGVEAKQPNSAIRKCVRVQLSGYSGDLVGALLCLQAPSASG

SEQ ID NO: 1030997 - protein, 98 aa, Homo sapiens
SSSPPSLPTNSDPSEPTQPPPYYVSTTPSSIQKNKLDTYRQRPPPPQSWSCTCRSVLVPIVCFSRLAPRPPRAVDIWAHSLPLQAPGAPPPRVLCVCG

SEQ ID NO: 1030998 - protein, 290 aa, Homo sapiens
DRKGTATGKQALHCTRMSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPSSTLTKC

SEQ ID NO: 1030999 - protein, 529 aa, Homo sapiens
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPHPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 1031000 - protein, 280 aa, Homo sapiens
MGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 1031001 - protein, 545 aa, Homo sapiens
DRKGTATGKQALHCTRMSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVFFMMFMITKCCLFCFRKLAKTGKKKKRD

SEQ ID NO: 1031002 - protein, 109 aa, Homo sapiens
MSVPAVSESICAPTNTVSISTCYDISRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 1031003 - protein, 332 aa, Homo sapiens
MKAFVQISGKDGTVVFSLGPVVQNLIEEKADLIASDLAQIPQKEDPLHYLRQWGKLTYGLFETPGIFSFHHPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 1031004 - protein, 529 aa, Homo sapiens; identical to SEQ ID NO: 1030999

SEQ ID NO: 1031005 - protein, 180 aa, Homo sapiens
MPALEGAPHTPPLPRRPRKGSSELGFPRVAPEDEVIVNQYVIRPGPSASAASSAAAGEPLECPTCGHSYNVTQRRPRVLSCLHSVCEQCLQILYESCPKYKFISCPTCRRETVLFTDYGLAALAVNTSILSRLPPEALTAPSGGQWGAEPEGSCYQTFRQYCGAACTCHVRNPLSACSIM

SEQ ID NO: 1031006 - protein, 234 aa, Homo sapiens
MAPSRNGMVLKPHFHKDWQRRVATWFNQPARKIRRRKARQAKARRIAPRPASGPIRPIVRCPTVRYHTKVRAGRGFSLGGAQGWPGIHKKVARTIGISVDPRRRNKSTESLQANVQRLKEYRSKLILFPRKPSAPKKGDSSAEELKLATQLTGPVMPVRNVYKKEKARVITEEEKNFKAFASLRMARANARLFGIRAKRARKPQNRMLNRTISLLGTWINNTRQVPQKKTRGLS

SEQ ID NO: 1031007 - protein, 155 aa, Homo sapiens
MAPSRNGMVLKPHFHKDWQRRVATWFNQPARKIRRRKARQAKARRIAPRPASGPIRPIVRCPTVRYHTKVRAGRGFSLGGAQGWPGIHKKVARTIGISVDPRRRNKSTESLQANVQRLKEYRSKNSFLLFPQRKPLSGPPKGKGGRTRVSLPWTR

SEQ ID NO: 1031008 - protein, 75 aa, Homo sapiens
GLLHARPRKPKRHRKVQKGSKDEHPKSHPKITTAAYYSVLKLGKQHSKLLSMHRPGAVAHTCNPSILGGQGGRIT

SEQ ID NO: 1031009 - protein, 644 aa, Homo sapiens [sequence omitted]

SEQ ID NO: 1031010 - protein, 644 aa, Homo sapiens [sequence omitted]

SEQ ID NO: 1031011 - protein, 432 aa, Homo sapiens
MKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPFPVVNLQVTANNLPSSTSYNRGDSHI

SEQ ID NO: 1031012 - protein, 644 aa, Homo sapiens [sequence omitted]

SEQ ID NO: 1031013 - protein, 644 aa, Homo sapiens [sequence omitted]

SEQ ID NO: 1031014 - protein, 644 aa, Homo sapiens [sequence omitted]

SEQ ID NO: 1031015 - protein, 644 aa, Homo sapiens [sequence omitted]

SEQ ID NO: 1031016 - protein, 644 aa, Homo sapiens [sequence omitted]

SEQ ID NO: 1031017 - protein, 644 aa, Homo sapiens [sequence omitted]

SEQ ID NO: 1031018 - protein, 644 aa, Homo sapiens [sequence omitted]

SEQ ID NO: 1031019 - protein, 644 aa, Homo sapiens [sequence omitted]

SEQ ID NO: 1031020 - protein, 644 aa, Homo sapiens [sequence omitted]

SEQ ID NO: 1031021 - protein, 414 aa, Homo sapiens
MKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSEVVTSEDGSDCPEAMDLGTLSGIGTLDGFRHRHPDEAAFFDTASTGKTFPGFFSPMLGEFVSETESRGSESGIFTNTKESSSHHPGIAEFPFPVVNLQVTANNLPSSTSYNRGDSHI

SEQ ID NO: 1031022 - protein, 414 aa, Homo sapiens
MKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGESRGSESGIFTNTKESSSHHPGIAEFPFPVVNLQVTANNLPSSTSYNRGDSHI

SEQ ID NO: 1031023 - protein, 432 aa, Homo sapiens; identical to SEQ ID NO: 1031011

SEQ ID NO: 1031024 - protein, 363 aa, Homo sapiens
MKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLMKLPSSTLPQLEKHSQVSSHLC

SEQ ID NO: 1031025 - protein, 432 aa, Homo sapiens; identical to SEQ ID NO: 1031011

SEQ ID NO: 1031026 - protein, 432 aa, Homo sapiens; identical to SEQ ID NO: 1031011

SEQ ID NO: 1031027 - protein, 644 aa, Homo sapiens [sequence omitted]

SEQ ID NO: 1031028 - protein, 644 aa, Homo sapiens [sequence omitted]

SEQ ID NO: 1031029 - protein, 644 aa, Homo sapiens [sequence omitted]

SEQ ID NO: 1031030 - protein, 644 aa, Homo sapiens [sequence omitted]

SEQ ID NO: 1031031 - protein, 644 aa, Homo sapiens [sequence omitted]

SEQ ID NO: 1031032 - protein, 644 aa, Homo sapiens [sequence omitted]

SEQ ID NO: 1031033 - protein, 3084 aa, Homo sapiens
QRLLRDRALFPAVHTMSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEPGWALSSCGTTMTACCWKLDTKYANKTCGLCGDFNGMPVVSELLSHNTKLTPMEFGNLQKMDDPTEQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNRCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVARYAQACHEVGTCVCLRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLACSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTPVTRNCHPRCTWTKWFDVDFPSPGPHGGDKETYNNIIRSGEKICRRTEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTIPASTPSTTSAPTTSTTSAPTTSISSAPTKQHNLGSYKQHNLCSYNQHNLCPYNQHNLFPYNQHNLCYYNQHNLCPYKQHNLHSTDQQNLSCPTTSTTSGPGTTPSPVTTTSTAPVSKTSTSHVSVSKTTHSQPVTSDCHPLCAWTKWFDVDFPSPGPHGGDKETYNNIIRSGEKICRRPEEITRLQCRAESHPEVNIEHLGQVVQCSREEGLVCRNQDQQGPFKMCLNYEVRVLCCETPRGCPVTSVTPYGTSPTNALYPSLSTSMVSASVASTSVASSSVASSSVAYSTQTCFCNVADRLYPAGSTIYRHRDLAGHCYYALCSQDCQVVRGVDSDCPSTTLPPAPATSPSISTSEPVTELGCPNAVPPRKKGETWATPNCSEATCEGNNVISLSPRTCPRVEKPTCANGYPAVKVADQDGCCHHYQCQCVCSGWGDPHYITFDGTYYTFLDNCTYVLVQQIVPVYGHFRVLVDNYFCGAEDGLSCPRSIILEYHQDRVVLTRKPVHGVMTNEIIFNNKVVSPGFRKNGIVVSRIGVKMYATIPELGVQVMFSGLIFSVEVPFSKFANNTEGQCGTCTNDRKDECRTPRGTVVASCSEMSGLWNVSIPDQPACHRPHPTPTTVGPTTVGSTTVGPTTVGSTTVGPTTPPAPCLPSPICHLILSKVFEPCHTVIPPLLFYEGCVFDRCHMTDLDVVCSSLELYAALCASHDICIDWRGRTGHMCPFTCPADKVYQPCGPSNPSYCYGNDSASLGALREAGPITEGCFCPEGMTLFSTSAQVCVPTGCPRCLGPHGEPVKVGHTVGMDCQECTCEAATWTLTCRPKLCPLPPACPLPGFVPVPAAPQAGQCCPQYSCACNTSRCPAPVGCPEGARAIPTYQEGACCPVQNCSWTVCSINGTLYQPGAVVSSSLCETCRCELPGGPPSDAFVVSCETQICNTHCPVGFEYQEQSGQCCGTCVQVACVTNTSKSPAHLFYPGETWSDAGNHCVTHQCEKHQDGLVVVTTKKACPPLSCSLDEARMSKDGCCRFCPLPPPPYQNQSTCAVYHRSLIIQQQGCSSSEPVRLAYCRGNCGDSSSMYSLEGNTVEHRCQCCQELRTSLRNVTLHCTDGSSRAFSYTEVEECGCMGRRCPAPGDTQHSEEAEPEPSQEAESGSWERGVPVSPMH

SEQ ID NO: 1031034 - protein, 2586 aa, Homo sapiens
QRLLRDRALFPAVHTMSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEPGWALSSCGTTMTACCWKLDTKYANKTCGLCGDFNGMPVVSELLSHNTKLTPMEFGNLQKMDDPTEQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNRCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVARYAQACHEVGTCVCLRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLACSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTPVTRNCHPRCTWTKWFDVDFPSPGPHGGDKETYNNIIRSGEKICRRTEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTIPASTPSTTSAPTTSTTSAPTTSISSAPTKQHNLGSYKQHNLCSYNQHNLCPYNQHNLFPYNQHNLCYYNQHNLCPYKQHNLHSTDQQNLSCPTTSTTSGPGTTPSPVTTTSTAPVSKTSTSHVSVSKTTHSQPVTSDCHPLCAWTKWFDVDFPSPGPHGGDKETYNNIIRSGEKICRRPEEITRLQCRAESHPEVNIEHLGQVVQCSREEGLVCRNQDQQGPFKMCLNYEVRVLCCETPRGCPVTSVTPYGTSPTNALYPSLSTSMVSASVASTSVASSSVASSSVAYSTQTCFCNVADRLYPAGSTIYRHRDLAGHCYYALCSQDCQVVRGVDSDCPSTTLPPAPATSPSISTSEPVTELGCPNAVPPRKKGETWATPNCSEATCEGNNVISLSPRTCPRVEKPTCANGYPAVKVADQDGCCHHYQCQCVCSGWGDPHYITFDGTYYTFLDNCTYVLVQQIVPVYGHFRVLVDNYFCGAEDGLSCPRSIILEYHQDRVVLTRKPVHGVMTNEIIFNNKVVSPGFRKNGIVVSRIGVKMYATIPELGVQVMFSGLIFSVEVPFSKFANNTEGQCGTCTNDRKDECRTPRGTVVASCSEMSGLWNVSIPDQPACHRPHPTPTTVGPTTVGSTTVGPTTVGSTTVGPTTVGSTTVGPTTPPAPCLPAAQ

SEQ ID NO: 1031035 - protein, 1942 aa, Homo sapiens
QRLLRDRALFPAVHTMSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEPGWALSSCGTTMTACCWKLDTKYANKTCGLCGDFNGMPVVSELLSHNTKLTPMEFGNLQKMDDPTEQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNRCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVARYAQACHEVGTCVCLRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLACSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTPVTRNCHPRCTWTKWFDVDFPSPGPHGGDKETYNNIIRSGEKICRRTEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAAATSSTTSSSGLRLPVTTTSTASVSRPVR

SEQ ID NO: 1031036 - protein, 493 aa, Homo sapiens
KTSTSHVSISKTTHTTPVTRNCHPRCTWTKWFDVDFPSPGPHGGDKETYNNIIRSGEKICRRTEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTIPASTPSTTSAPTTSTTSAPTTSISSAPTKQHNLGSYKQHNLCSYNQHNLCPYNQHNLFPYNQHNLCYYNQHNLCPYKQHNLHSTDQQNLSCPTTSTTSGPGTTPSPVTTTSTAPVSKTSTSHVSVSKTTHSQPVTSDCHPLCAWTKWFDVDFPSPGPHGGDKETYNNIIRSGEKICRRPEEITRLQCRAESHPEVNIEHLGQVVQCSREEGLVCRNQDQQGPFKMCLNYEVRVLCCETPRGCPVTSTSVTAPSTPSGRATSPTQSTSSWQKSRTTTFGDKQHNLHYTDQHNLMPLQVAQPSFNTQHIRLA

SEQ ID NO: 1031037 - protein, 3084 aa, Homo sapiens; identical to SEQ ID NO: 1031033

SEQ ID NO: 1031038 - protein, 3084 aa, Homo sapiens; identical to SEQ ID NO: 1031033

SEQ ID NO: 1031039 - protein, 1955 aa, Homo sapiens
MSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEPGWALSSCGTTMTACCWKLDTKYANKTCGLCGDFNGMPVVSELLSHNTKLTPMEFGNLQKMDDPTEQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNRCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVARYAQACHEVGTCVCLRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLACSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTPVTRNCHPRCTWTKWFDVDFPSPGPHGGDKETYNNIIRSGEKICRRTEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTIPASTPSTRDWCATRGIISLCSWSSRHLLCPVSPLNILCHPLFYPVLSLGIL

SEQ ID NO: 1031040 - protein, 1952 aa, Homo sapiens
QRLLRDRALFPAVHTMSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEPGWALSSCGTTMTACCWKLDTKYANKTCGLCGDFNGMPVVSELLSHNTKLTPMEFGNLQKMDDPTEQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNRCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVARYAQACHEVGTCVCLRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLACSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTPVTRNCHPRCTWTKWFDVDFPSPGPHGGDKETYNNIIRSGEKICRRTEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAGPYNQHNLCSYSQNNLCSYNQNNFCLSSQHNLWSWKYSH

SEQ ID NO: 1031041 - protein, 2987 aa, Homo sapiens
QRLLRDRALFPAVHTMSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEPGWALSSCGTTMTACCWKLDTKYANKTCGLCGDFNGMPVVSELLSHNTKLTPMEFGNLQKMDDPTEQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNRCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVARYAQACHEVGTCVCLRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLACSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTPVTRNCHPRCTWTKWFDVDFPSPGPHGGDKETYNNIIRSGEKICRRTEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTTSGPGTTPSPVTTTSTAPVSKTSTSHVSVSKTTHSQPVTSDCHPLCAWTKWFDVDFPSPGPHGGDKETYNNIIRSGEKICRRPEEITRLQCRAESHPEVNIEHLGQVVQCSREEGLVCRNQDQQGPFKMCLNYEVRVLCCETPRGCPVTSVTPYGTSPTNALYPSLSTSMVSASVASTSVASSSVASSSVAYSTQTCFCNVADRLYPAGSTIYRHRDLAGHCYYALCSQDCQVVRGVDSDCPSTTLPPAPATSPSISTSEPVTELGCPNAVPPRKKGETWATPNCSEATCEGNNVISLSPRTCPRVEKPTCANGYPAVKVADQDGCCHHYQCQCVCSGWGDPHYITFDGTYYTFLDNCTYVLVQQIVPVYGHFRVLVDNYFCGAEDGLSCPRSIILEYHQDRVVLTRKPVHGVMTNEIIFNNKVVSPGFRKNGIVVSRIGVKMYATIPELGVQVMFSGLIFSVEVPFSKFANNTEGQCGTCTNDRKDECRTPRGTVVASCSEMSGLWNVSIPDQPACHRPHPTPTTVGPTTVGSTTVGPTTVGSTTVGPTTPPAPCLPSPICHLILSKVFEPCHTVIPPLLFYEGCVFDRCHMTDLDVVCSSLELYAALCASHDICIDWRGRTGHMCPFTCPADKVYQPCGPSNPSYCYGNDSASLGALREAGPITEGCFCPEGMTLFSTSAQVCVPTGCPRCLGPHGEPVKVGHTVGMDCQECTCEAATWTLTCRPKLCPLPPACPLPGFVPVPAAPQAGQCCPQYSCACNTSRCPAPVGCPEGARAIPTYQEGACCPVQNCSWTVCSINGTLYQPGAVVSSSLCETCRCELPGGPPSDAFVVSCETQICNTHCPVGFEYQEQSGQCCGTCVQVACVTNTSKSPAHLFYPGETWSDAGNHCVTHQCEKHQDGLVVVTTKKACPPLSCSLDEARMSKDGCCRFCPLPPPPYQNQSTCAVYHRSLIIQQQGCSSSEPVRLAYCRGNCGDSSSMYSLEGNTVEHRCQCCQELRTSLRNVTLHCTDGSSRAFSYTEVEECGCMGRRCPAPGDTQHSEEAEPEPSQEAESGSWERGVPVSPMH

SEQ ID NO: 1031042 - protein, 2229 aa, Homo sapiens
QRLLRDRALFPAVHTMSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEPGWALSSCGTTMTACCWKLDTKYANKTCGLCGDFNGMPVVSELLSHNTKLTPMEFGNLQKMDDPTEQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNRCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVARYAQACHEVGTCVCLRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLACSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTPVTRNCHPRCTWTKWFDVDFPSPGPHGGDKETYNNIIRSGEKICRRTEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTIPASTPSTTSAPTTSTTSAPTTSISSAPTKQHNLGSYKQHNLCSYNQHNLCPYNQHNLFPYNQHNLCYYNQHNLCPYKQHNLHSTDQQNLSCPTTSTTSGPGTTPSPVTTTSTAPVSKTSTSHVSVSKTTHSQPVTSDCHPLCAWTKWFDVDFPSPGPHGGDKETYNNIIRSGEKICRRPEEITRLQCRAESHPEVNIEHLGQVVQCSREEGLVCRNQDQQGPFKMCLNYEVRVLCCETPRGCPVTSTSVTAPSTPSGRATSPTQSTSSWQKSRTTTFGDKQHNLHYTDQHNLMPLQVAQPSFNTQHIRLA

SEQ ID NO: 1031043 - protein, 96 aa, Homo sapiens
ENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 1031044 - protein, 74 aa, Homo sapiens
PGGTRRRLIKEPRDLSRFKTVYIEHLKGVLEQGLLIRPRLLPRGAALPRHLPREADFPGSVAVWLSFLKSPWLP

SEQ ID NO: 1031045 - protein, 96 aa, Homo sapiens; identical to SEQ ID NO: 1031043

SEQ ID NO: 1031046 - protein, 96 aa, Homo sapiens; identical to SEQ ID NO: 1031043

SEQ ID NO: 1031047 - protein, 96 aa, Homo sapiens; identical to SEQ ID NO: 1031043

SEQ ID NO: 1031048 - protein, 147 aa, Homo sapiens
MGTPASVVSEPPPCRAPIEAVAGKQASGKIFQERELLGIQGLFQRRGEPAGRGRGHRSSNVHGDHRVLRRSRGLRRRRPQRESLGIGNKLSARIWSPVLSWQPRSARRSSVEVLALGEKGGSRMGSGPKTHRSWSESEGFFKLGRGE

SEQ ID NO: 1031049 - protein, 561 aa, Homo sapiens
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVRLQVGLYAVYLLDWLSVFDKQQFLILRLEDHASNVKYTMHKVFQFLNLGPLSEKQEALMTKSPASNARRPEDRNLGPMWPITQKILRDFYRPFNARLAQVLADEAFAWKTT

SEQ ID NO: 1031050 - protein, 90 aa, Homo sapiens
LRSMLVNCNRIPFPQNQYAMIIRARTDGYGSAVVQPSFCWCCLSAIREGTHSPFEGVQRALSARMARAVFATEGACVLNSHLQGQSPPSL

SEQ ID NO: 1031051 - protein, 279 aa, Homo sapiens
WVAVAGGASNLLSLESQMPAKADSLLPLLKRKASGPGVALDLEPLRGSLNHTPAHLECFLFPGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVRLQVGLYAVYLLDWLSVFDKQQFLILRLEDHASNVKYTMHKVFQFLNLGPLSEKQEALMTKSPASNARRPEDRNLGPMWPITQKILRDFYRPFNARLAQVLADEAFAWKTT

SEQ ID NO: 1031052 - protein, 571 aa, Homo sapiens
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVRLQVGLYAVYLLDWLSVFDKQQFLILRLEDHASNVKYTMHKVFQFLNLRSQSRVAEFWLLIMDAGPLGHERLPSACGYQPPQGPESHFVVQATLLNEGDAGKRHVLAERVLPMWTGHRGMA

SEQ ID NO: 1031053 - protein, 561 aa, Homo sapiens; identical to SEQ ID NO: 1031049

SEQ ID NO: 1031054 - protein, 561 aa, Homo sapiens; identical to SEQ ID NO: 1031049

SEQ ID NO: 1031055 - protein, 482 aa, Homo sapiens
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVCTPAPVPPELAPGRRSWFVVIMQAALWVCVSA

SEQ ID NO: 1031056 - protein, 660 aa, Homo sapiens
ATGTPTRTPSRTAPGALTAKPPLAPKPGTTVASGVTARSASGQVTGGHGAAAATSASAGQAPEDPSGPGTGPSGTCEAPVAVVTVTPAPEPAENSQDLGSTSSLGPGISGPRGQAPDTLSYLDSVSLMSGTLESLADDVSSMGSDSEINGLALRKTDKYGFLGGSQYSGSLESSIPVDVARQRELKWLDMFSNWDKWLSRRFQKVKLRCRKGIPSSLRAKAWQYLSNSKELLEQNPGKFEELERAPGDPKWLDVIEKDLHRQFPFHEMFAARGGHGQQDLYRILKAYTIYRPDEGYCQAQAPVAAVLLMHMPAEQAFWCLVQICDKYLPGYYSAGLEAIQLDGEIFFALLRRASPLAHRHLRRQRIDPVLYMTEWFMCIFARTLPWASVLRVWDMFFCEGVKIIFRVALVLLRHTLGSVEKLRSCQGMYETMEQLRNLPQQCMQEDFLVHEVTNLPVTEALIERENAAQLKKWRETRGELQYRPSRRLHGSRAIHEERRRQQPPLGPSSSLLSLPGLKSRGSRAAGGAPSPPPPVRRASAGPAPGPVVTAEGLHPSLPSPTGNSTPLGSSKETRKQEKERQKQEKERQKQEKEREKERQKQEKEREKQEKEREKQEKERQKQEKKAQGRKLSLRRKADGPPGPHDGGDRPSAEARQDAYF

SEQ ID NO: 1031057 - protein, 226 aa, Homo sapiens
ATGTPTRTPSRTAPGALTAKPPLAPKPGTTVASGVTARSASGQVTGGHGAAAATSASAGQAPEDPSGPGTGPSGTCEAPVAVVTVTPAPEPAENSQDLGSTSSLGPGISGPRGQAPDTLSYLDSVSLMSGTLESLADDVSSMGSDSEINGLALRKTDKYGFLGGSQYSGSLEYQWAPSGTASGKQRLGEGEAKTIHFAQTLAAQPPLRIHGVISASCRVLSILRCL

SEQ ID NO: 1031058 - protein, 636 aa, Homo sapiens
MEEPGDKLWDESGTGFGDSSSQPVTALTVFPNPHRQQDLYRILKAYTIYRPDEGYCQAQAPVAAVLLMHMPAEVSAWSGPGGAGGSHPTVVMGELPAPCFSGPTPPPCSCSSQQAFWCLVQICDKYLPGYYSAGLVSVWRLGASGAVAFPPGCRQVLALPHPGLPGFCPQGRPVLPMMGAQLTWPSSHGLSHLQEAIQLDGEIFFALLRRASPLAHRHLRRQRIDPVLYMTEWFMCIFARTLPWASVLRVWDMFFCEGTSVALQAMRGWGFCGGYQGFCHISGGPWTKGTCWVEVSPEAAGGWRNRPDFSSATNPEPALPAKILETDSSSCTFTGPQFPHLRLAVDGDGGCESILIRTAEILGLTTPCSLLSTPAGVKIIFRVALVLLRHTLGSVEKLRSCQGMYETMEQLRNLPQQCMQEDFLVHEVTNLPVTEALIERENAAQLKKWRETRGELQYRPSRRLHGSRAIHEERRRQQPPLGPSSSLLSLPGLKSRGSRAAGGAPSPPPPVRRASAGPAPGPVVTAEGLHPSLPSPTGNSTPLGSSKETRKQEKERQKQEKERQKQEKEREKERQKQEKEREKQEKEREKQEKERQKQEKKAQGRKLSLRRKADGPPGPHDGGDRPSAEARQDAYF

SEQ ID NO: 1031059 - protein, 757 aa, Homo sapiens
MPKWPDILMFGSSQTIQFLFELGEVACLSSPCNAGFTLLLLTPSVLPRPCRESSIPVDVARQRELKWLDMFSNWDKWLSRRFQKVKLRCRKGIPSSLRAKAWQYLSNSKELLEQNPGKFEELERAPGDPKWLDVIEKDLHRQFPFHEMFAARGGHGQQDLYRILKAYTIYRPDEGYCQAQAPVAAVLLMHMPAEVSAWSGPGGAGGSHPTVVMGELPAPCFSGPTPPPCSCSSQQAFWCLVQICDKYLPGYYSAGLVSVWRLGASGAVAFPPGCRQVLALPHPGLPGFCPQGRPVLPMMGAQLTWPSSHGLSHLQEAIQLDGEIFFALLRRASPLAHRHLRRQRIDPVLYMTEWFMCIFARTLPWASVLRVWDMFFCEGTSVALQAMRGWGFCGGYQGFCHISGGPWTKGTCWVEVSPEAAGGWRNRPDFSSATNPEPALPAKILETDSSSCTFTGPQFPHLRLAVDGDGGCESILIRKAEILGLTTPCSLLSTPAGVKIIFRVALVLLRHTLGSVEKLRSCQGMYETMEQLRNLPQQCMQEDFLVHEVTNLPVTEALIERENAAQLKKWRETRGELQYRPSRRLHGSRAIHEERRRQQPPLGPSSSLLSLPGLKSRGSRAAGGAPSPPPPVRRASAGPAPGPVVTAEGLHPSLPSPTGNSTPLGSSKETRKQEKERQKQEKERQKQEKEREKERQKQEKEREKQEKEREKQEKERQKQEKKAQGRKLSLRRKADGPPGPHDGGDRPSAEARQDAYF

SEQ ID NO: 1031060 - protein, 238 aa, Homo sapiens
DAQLDGCPVEDYTGLGEHMCLCVCVRVCQTVSLTPGCLAGGAEQSDADTCKTPLDIAPPPLRSLSTPGSGERRSGRSRRKSERSRKRSERSRRRSGRSRRRRLKAGSFRCVERQMGPQAPMMVGTGPQPRPGRTLTSDLCPGAGLHGPPLSLSQEQAWPKVPPPSTLSGCPLLGKVAWFPISSPAADPYTGRTDGQLQMSLEPLISHEAQLGSLSLLPQFPLGPLLGAVLNGPLSSQG

SEQ ID NO: 1031061 - protein, 106 aa, Homo sapiens
SIGRSRKQGSGGGKAGSGRSRKQKERQKQEKERQKQEKEREKERQKQEKEREKQEKEREKQEKERQKQEKKAQGRKLSLRRKADGPPGPHDGGDRPSAEARQDAYF

SEQ ID NO: 1031062 - protein, 323 aa, Homo sapiens
ATGTPTRTPSRTAPGALTAKPPLAPKPGTTVASGVTARSASGQVTGGHGAAAATSASAGQAPEDPSGPGTGPSGTCEAPVAVVTVTPAPEPAENSQDLGSTSSLGPGISGPRGQAPDTLSYLDSVSLMSGTLESLADDVSSMGSDSEINGLALRKTDKYGFLGGSQYSGSLESSIPVDVARQRELKWLDMFSNWDKWLSRRFQKVKLRCRKGIPSSLRAKAWQYLSNSKELLEQNPGKFEELERAPGDPKWLDVIEKDLHRQFPFHEMFAARGGHGQQGTCTRLEGLTPYPGLDQRGYLAKAQGPPVGFAGPWLNATLPLLER

SEQ ID NO: 1031063 - protein, 877 aa, Homo sapiens
ATGTPTRTPSRTAPGALTAKPPLAPKPGTTVASGVTARSASGQVTGGHGAAAATSASAGQAPEDPSGPGTGPSGTCEAPVAVVTVTPAPEPAENSQDLGSTSSLGPGISGPRGQAPDTLSYLDSVSLMSGTLESLADDVSSMGSDSEINGLALRKTDKYGFLGGSQYSGSLESSIPVDVARQRELKWLDMFSNWDKWLSRRFQKVKLRCRKGIPSSLRAKAWQYLSNSKELLEQNPGKFEELERAPGDPKWLDVIEKDLHRQFPFHEMFAARGGHGQQDLYRILKAYTIYRPDEGYCQAQAPVAAVLLMHMPAEVSAWSGPGGAGGSHPTVVMGELPAPCFSGPTPPPCSCSSQQAFWCLVQICDKYLPGYYSAGLVSVWRLGASGAVAFPPGCRQVLALPHPGLPGFCPQGRPVLPMMGAQLTWPSSHGLSHLQEAIQLDGEIFFALLRRASPLAHRHLRRQRIDPVLYMTEWFMCIFARTLPWASVLRVWDMFFCEGTSVALQAMRGWGFCGGYQGFCHISGGPWTKGTCWVEVSPEAAGGWRNRPDFSSATNPEPALPAKILETDSSSCTFTGPQFPHLRLAVDGDGGCESILIRKAEILGLTTPCSLLSTPAGVKIIFRVALVLLRHTLGSVEKLRSCQGMYETMEQLRNLPQQCMQEDFLVHEVTNLPVTEALIERENAAQLKKWRETRGELQYRPSRRLHGSRAIHEERRRQQPPLGPSSSLLSLPGLKSRGSRAAGGAPSPPPPVRRASAGPAPGPVVTAEGLHPSLPSPTGNSTPLGSSKETRKQEKERQKQEKERQKQEKEREKERQKQEKEREKQEKEREKQEKERQKQEKKAQGRKLSLRRKADGPPGPHDGGDRPSAEARQDAYF

SEQ ID NO: 1031064 - protein, 597 aa, Homo sapiens
ATGTPTRTPSRTAPGALTAKPPLAPKPGTTVASGVTARSASGQVTGGHGAAAATSASAGQAPEDPSGPGTGPSGTCEAPVAVVTVTPAPEPAENSQDLGSTSSLGPGISGPRGQAPDTLSYLDSVSLMSGTLESLADDVSSMGSDSEINGLALRKTDKYGFLGGSQYSGSLESSIPVDVARQRELKWLDMFSNWDKWLSRRFQKVKLRCRKGIPSSLRAKAWQYLSNSKELLEQNPGKFEELERAPGDPKWLDVIEKDLHRQFPFHEMFAARGGHGQQDLYRILKAYTIYRPDEGYCQAQAPVAAVLLMHMPAEQAFWCLVQICDKYLPGYYSAGLGVKIIFRVALVLLRHTLGSVEKLRSCQGMYETMEQLRNLPQQCMQEDFLVHEVTNLPVTEALIERENAAQLKKWRETRGELQYRPSRRLHGSRAIHEERRRQQPPLGPSSSLLSLPGLKSRGSRAAGGAPSPPPPVRRASAGPAPGPVVTAEGLHPSLPSPTGNSTPLGSSKETRKQEKERQKQEKERQKQEKEREKERQKQEKEREKQEKEREKQEKERQKQEKKAQGRKLSLRRKADGPPGPHDGGDRPSAEARQDAYF

SEQ ID NO: 1031065 - protein, 660 aa, Homo sapiens; identical to SEQ ID NO: 1031056

SEQ ID NO: 1031066 - protein, 97 aa, Homo sapiens
SPSSRRTSKAASSKRQRSACWGVCCVGLVVGVLALSSVLWFSFHNAPVPSASDPGSERFLHSIAPLTMRWSWLPFPCLQPSLSPPLPGQGSHSGPVL

SEQ ID NO: 1031067 - protein, 145 aa, Homo sapiens [sequence omitted]

SEQ ID NO: 1031068 - protein, 162 aa, Homo sapiens
EADSIPLAAITEAGAAKMKFNPFVTSDRSKNRKRHFNAPSHIRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQVGKEKGKYKEETIEKMQE

SEQ ID NO: 1031069 - protein, 123 aa, Homo sapiens
SGIASGARLLLRMLSALPGWGPAHLQRPLLGPASCLGILRPAMTAHSFALPVIIFTTFWGLVGIAGPWFVPKGPNRGVIITMLVATAVCCYLFWLIAILAQLNPLFGPQLKNETIWYVRFLWE

SEQ ID NO: 1031070 - protein, 92 aa, Homo sapiens [sequence omitted]

SEQ ID NO: 1031071 - protein, 206 aa, Homo sapiens
SGIASGARLLLRMLSALPGWGPAHLQRPLLGPASCLGILRPAMTAHSFALPVIIFTTFWGLVGIAGPWFVPKGPNRGVIITMLVATAVCCYLLCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGQMPGLSPS

SEQ ID NO: 1031072 - protein, 314 aa, Homo sapiens
SGIASGARLLLRMLSALPGWGPAHLQRPLLGPASCLGILRPAMTAHSFALPVIIFTTFWGLVGIAGPWFVPKGPNRGVIITMLVATAVCCYLFWHHRHSWSQLKPLFVAPACKNEIIVCTVLLSVWEDLVSHPNRRVSHASSRTEPDETSNMITMNKDTLSITEPHHTHKTPPPHNYVWSPAPSCWHPETRTRRACLVPGSLPSLPSQPGPWGALGTAAAEGMSCSNTRTALEFALFPKEMLLGSWYGWGLSLYRRGRCQDSAHPEEDTCPHGEGAPAQAGESVPSQQLCHHPAGNWGGLYWVIGKAFSLAWNC

SEQ ID NO: 1031073 - protein, 162 aa, Homo sapiens; identical to SEQ ID NO: 1031068

SEQ ID NO: 1031074 - protein, 123 aa, Homo sapiens; identical to SEQ ID NO: 1031069

SEQ ID NO: 1031075 - protein, 228 aa, Homo sapiens
GRVGKIKASFGLELAYAKGRLDIVIITMLVATAVCCYLFWLIAILAQLNPLFGPQLKNETIWYVRFLWLSPRAPYQVPSSRNDCGSTVPDNPFVRTLPHTTMSGHQLPPAGTQRPGPAGPAWFLEVFPVFPASPGPGEPWAQQRPRGCPAPIPALLWSLPSFPRRCCWGAGMGGVFPFTDGADARTQPILRRTRVLMERVLRPRRGSRCPVSSSATILLGTGGASIGL

SEQ ID NO: 1031076 - protein, 196 aa, Homo sapiens
RPLQHQNVPSQQLCHHPAGNWGVTRRPRPRCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGPVLTGAPGEETTASLLYGLLMWPAILFSGHCLWSSRRLGCLSLTCQFLAGQLLRAQAGASH

SEQ ID NO: 1031077 - protein, 92 aa, Homo sapiens [sequence omitted]

SEQ ID NO: 1031078 - protein, 106 aa, Homo sapiens
RGTWEQDPCRWCAPKTIARRAPAPLSTRGPGPGVAFVPFIHCAINPLSPIKKKSAAAACPGHGLLFKTKLEKSLAWKEAQPELQEPQPAAPGTPGGFSEVMGSALA

SEQ ID NO: 1031079 - protein, 155 aa, Homo sapiens
MQSVTSVETQRATDVCSACAAAAARSEPPKRLQTAQVTDCFLKPNWRSLWPGKRPSLSCRSLSQQHLEHQVASPKSWAVPWPEGPQPPPPGLLLEPGHVLLKKMPFTQGISCYLMWKDTPMSPFGPLWGPGNAAVGSRPQAGPALSSARVCKSEQ

SEQ ID NO: 1031080 - protein, 155 aa, Homo sapiens; identical to SEQ ID NO: 1031079

SEQ ID NO: 1031081 - protein, 494 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAGGAVAQDSSQAPCTRPDTTSPEGNLHNPALFEGRSPAVWELAEEYLDIVREHPCPLSYVRAHLFKLWHHTLQVHQELREELAKVKTLEGIAAVSQELKLRCQEEISRQEGAKPTGDLPFHWICQPYIRPGPREGSKEKAGARSKRALEEEEGGTEVLSKNKQKKQLRNPHKTFDPSLKPKYAKCDQCGNPKGNRCVFSLCRGCCKKRASKETADCPGHGLLFKTKLEKSLAWKEAQPELQEPQPAAPGTPGGFSEVMGSALA

SEQ ID NO: 1031082 - protein, 492 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHPCPLSYVRAHLFKLWHHTLQVHQELREELAKVKTLEGIAAVSQELKLRCQEEISRQEGAKPTGDLPFHWICQPYIRPGPREGSKEKAGARSKRALEEEEGGTEVLSKNKQKKQLRNPHKTFDPSLKPKYAKCDQCGNPKGNRCVFSLCRGCCKKRASKETADCPGLLLEPGHVLLKKMPFTQGISCYLMWKDTPMSPFGPLWGPGNAAVGSRPQAGPALSSARVCKSEQ

SEQ ID NO: 1031083 - protein, 333 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREQGEGRCAQQAGPGGRGGWHGGPVQEQAKEAAEEPPQDLRPLSEAKYARCPVEPKGKMGSTVPGCEKSPKMG

SEQ ID NO: 1031084 - protein, 554 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHPCPLSYVRAHLFKLWHHTLQVHQELREELAKVKTLEGIAAVSQELKLRCQEEISRQEGAKPTGDLPFHWICQPYIRPGPREGSKEKAGARSKRALEEEEGGTEVLSKNKQKKQLRNPHKTFDPSLKPKYAKCDQCGNPKVSGFRLQATKASALGVGRVVSALLGVAGLVPAQLGLQRGSRWHGCLRTAPCFQPSPCPGLEGKRVWVGWGEGEASGLGAVPRAASRPWASGRGFPSGAAPLLASLAPGVVLATGSRDFLCPGQQMCVQPVPRLLQEASLQRDCRLPRSRIAF

SEQ ID NO: 1031085 - protein, 227 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGRKRRVARRSCPRTSKRSS

SEQ ID NO: 1031086 - protein, 516 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGNLHNPALFEGRSPAVWELAEEYLDIVREHPCPLSYVRAHLFKLWHHTLQVHQELREELAKVKTLEGIAAVSQELKLRCQEEISRQEGAKPTGDLPFHWICQPYIRPGPREGSKEKAGARSKRALEEEEGGTEVLSKNKQKKQLRNPHKTFDPSLKPKYAKCDQCGNPKVSGFRLQATKASALGVGRVVSALLGVAGLVPAQLGLQRGSRWHGCLRTAPCFQPSPCPGLEGKRVWVGWGEGEASGLGAVPRAASRPWASGRGFPSGEQAPGWTCPVLSTRVQK

SEQ ID NO: 1031087 - protein, 323 aa, Homo sapiens
AARAADSISEAPDSLVTVLNGLPEGKEGTPHSSGTRHGRLAPHPDSDPCGCGCWAPLTVSLGSARCPPLRPREGSKEKAGARSKRALEEEEGGTEVLSKNKQKKQLRNPHKTFDPSLKPKYAKCDQCGNPKVSGFRLQATKASALGVGRVVSALLGVAGLVPAQLGLQRGSRWHGCLRTAPSSSQAPAQAWRGRESGWVGVRERHLAWEQFPGLHPGRGHLAEASPVGLLPCWPAWPREWCWPQAPEISCAQGNRCVFSLCRGCCKKRASKETADCPGHGLLFKTKLEKSLAWKEAQPELQEPQPAAPGTPGGFSEVMGSALA

SEQ ID NO: 1031088 - protein, 325 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSARRAYHAQPQPLCSRARVPLPCWDAGLKRTYLGPSVAGDANSLALACLLPYQAPHSAFNVLEGSPTAAGCCSPGMLRDEAMLVPTGCKNPVDAA

SEQ ID NO: 1031089 - protein, 155 aa, Homo sapiens; identical to SEQ ID NO: 1031079

SEQ ID NO: 1031090 - protein, 155 aa, Homo sapiens; identical to SEQ ID NO: 1031079

SEQ ID NO: 1031091 - protein, 155 aa, Homo sapiens; identical to SEQ ID NO: 1031079

SEQ ID NO: 1031092 - protein, 151 aa, Homo sapiens
RGGGAEPWARLRPGGGPGAVRAFAAPRELQGPRAAARPERGGPGTPAPGALGAKGARRTRRGPRAPGDDAKAAGLRVLEPHPARGPPRRGPHGGPERAGLEAAEPAPRGTALLHAHAACPGLCPRRQLPEGEPVLRGVPRGPAPHRAVLCQ

SEQ ID NO: 1031093 - protein, 190 aa, Homo sapiens
PWTVAGTPPVCLGRTESCSSCAAHQPTCFLSVSCRMVPPASPHTLLTEGKADVASLHPLPSLSLLGLAGHSWHGRHQQAPCRRTGQPPQPGQTLALTHQHPFVLFLAKYAKCDQCGNPKGNRCVFSLCRGCCKKRASKETADCPGHGLLFKTKLEKSLAWKEAQPELQEPQPAAPGTPGGFSEVMGSALA

SEQ ID NO: 1031094 - protein, 279 aa, Homo sapiens
MPKLQGFEFWSRTLRGARHVVAPMVDQSELAWRLLSRRHGAQLCYTPMLHAQVFVRDANYRKENLYCEVCPEDRPLIVQFCANDPEVFVQAALLAQDYCDAIDLNLGCPQMIAKRGHYGAFLQDEWDLLQRMILLAHEKLSVPVTCKIRVFPEIDKTVRYAQMLEKAGCQLLTVHGRTKEQKGPLSGAASWEHIKAVRKAVAIPVFANGNIQCLQDVERCLRDTGVQGVMSAEGCPQMIAKRGHYGAFQDEWDLLQRMILAHEKLSVPVTCKIRVFPEI

SEQ ID NO: 1031095 - protein, 248 aa, Homo sapiens
EQQEEAEHSIVGTRLVSGQLQPSQPNADQGKLTTMRIAVIGFGLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVNGLRSKSKKFARPESGTLMLQTRTSAHNGKRGVDMVHTRAIPVAQELAAASGLDKPREGTVLKS

SEQ ID NO: 1031096 - protein, 263 aa, Homo sapiens
EQQEEAEHSIVGTRLVSGQLQPSQPNADQGKLTTMRIAVIGFGLLGITCAIPVKQADSGSSEEKQLYNKYPDAVATWLNPDPSQKQNLLAPQKCCGPLKKPMTLNKRPFQVSPTKAMTTWMIWMMKMMMTMWTARTPLTRTTLNDVDDTDDSHQSDESHHSDESDELVTDFPTDLPATEVFTPVVPTVDTYDGRGDSVVNGLRSKSKKFARPESGTLMLQTRTSAHNGKRGVDMVHTRAIPVAQELAAASGLDKPREGTVLKS

SEQ ID NO: 1031097 - protein, 161 aa, Homo sapiens
SDFEHTIHVGFDAVTGEFTGMPEQWARLLQTSNITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLSM

SEQ ID NO: 1031098 - protein, 255 aa, Homo sapiens
SDFEHTIHVGFDAVTGEFTGMPEQWARLLQTSNITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLRTIVSIGDPKKKYTRYEKIGQGASGTVFTATDVALGQEVAIKQINLQKQPKKELIINEILVMKELKNPNIVNFLDSYLVGELFVVMEYLAGGSSLM

SEQ ID NO: 1031099 - protein, 235 aa, Homo sapiens
SDFEHTIHVGFDAVTGEFTGMPEQWARLLQTSNITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLRTIVSIGDPKKKYTRYEKIGQGASGTVFTATDVALGQEVAIKQINLQKQPKKELIINEILVMKELKNPNIVNFLDR

SEQ ID NO: 1031100 - protein, 178 aa, Homo sapiens
RRAWVALGRIWVPAGCAGLRFRPCHLAAPYPTRGRLMLGLVGEIITALRAEESSRLVALEVLRRFWRPLEQHYLDLDETGPLLPGLVEYMNSGPVVATGLGGAGRGEEHGRVMLGETHPAEFASPAPIRGDFCIQVGKDTDYQWHVIQYKSAEKEISLWFKPEELVDYKSCAHDWVYE

SEQ ID NO: 1031101 - protein, 178 aa, Homo sapiens; identical to SEQ ID NO: 1031100

SEQ ID NO: 1031102 - protein, 147 aa, Homo sapiens
QAPWLASAKVAVGCPQASAWPPPPISYQEELYDFPSCGKWRARSQGSAEASQWPAPASPGGALASPEPGRKILPRMISHSELRKLFYSADAVCFDVDSTVISEEGIGRISLCHQAGVQWCNLGSLQPPPPGFKQFSCLHLPELAETG

SEQ ID NO: 1031103 - protein, 412 aa, Homo sapiens
SELIRHQITHTGEKPYECMNVGRHFAVSHTLLDIRASYNQNPINVMSVGKLLIRAQSLFYIRGFILERNPIPVINVAKPSVGFQILLIINEFTLERSLTHVISAIKCLVEDEILLNITEFIQVRNPMNVMTVGKPLVRAPTLFFIRESTLERNLMHVVIVLKALVAVQILLSIKEYTLERNHMHVISVIKVLVKAQTSLNIREYTLVKSLIIAIVVRKPSVRVLTLFFIREFTLEKNYYLCTQCSKSFSQISDLIKHQRIHTGEKPYKCSECRKAFSQCSALTLHQRIHTGKKPNPCDECGKSFSRRSDLINHQKIHTGEKPYKCDACGKAFSTCTDLIEHQKTHAEEKPYQCVQCSRSCSQLSELTIHEEVHCGEDSQNVMNVRKPLVCTPTLFSTRDTVPEKNLMNAVDY

SEQ ID NO: 1031104 - protein, 485 aa, Homo sapiens
EKNPINAVIVVKVLASAQIWLNIRESILERSLILVTSVTNILDSDVIKHQRIHTGEKPYKCDVCGKAFSQSSDLILHQRIHTGEKPYPCNQCSKSFSQNSDLIKHRRIHTGEKPYKCNECGKAFNQSSVLILHQRIHTGEKPYPCDQCSKTFSRLSDLINHQRIHTGEKPYPCNQCNKMFSQRMRSLLNITEFIQVRNPMNVMTVGKPLVRAPTLFFIRESTLERNLMHVVIVLKALVAVQILLSIKEYTLERNHMHVISVIKVLVKAQTSLNIREYTLVKSLIIAIVVRKPSVRVLTLFFIREFTLEKNYYLCTQCSKSFSQISDLIKHQRIHTGEKPYKCSECRKAFSQCSALTLHQRIHTGKKPNPCDECGKSFSRRSDLINHQKIHTGEKPYKCDACGKAFSTCTDLIEHQKTHAEEKPYQCVQCSRSCSQLSELTIHEEVHCGEDSQNVMNVRKPLVCTPTLFSTRDTVPEKNLMNAVDY

SEQ ID NO: 1031105 - protein, 461 aa, Homo sapiens; identical to SEQ ID NO: 816332

SEQ ID NO: 1031106 - protein, 493 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQSECSREGAGARPWPHRHSTWEFMLRPESPIQACVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 1031107 - protein, 314 aa, Homo sapiens
MSHVRGVREQCVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 1031108 - protein, 483 aa, Homo sapiens
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 1031109 - protein, 483 aa, Homo sapiens; identical to SEQ ID NO: 1031108

SEQ ID NO: 1031110 - protein, 483 aa, Homo sapiens; identical to SEQ ID NO: 1031108

SEQ ID NO: 1031111 - protein, 483 aa, Homo sapiens; identical to SEQ ID NO: 1031108

SEQ ID NO: 1031112 - protein, 256 aa, Homo sapiens
MKEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 1031113 - protein, 249 aa, Homo sapiens
MKEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPAQYSWASWSGRVKSSADKPQAGVKNPPVGDGLARPPRRGPPPW

SEQ ID NO: 1031114 - protein, 261 aa, Homo sapiens
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYERGDPGAAVPDLGHICGAVHGQQPLPGHGQHHC

SEQ ID NO: 1031115 - protein, 261 aa, Homo sapiens; identical to SEQ ID NO: 1031114

SEQ ID NO: 1031116 - protein, 279 aa, Homo sapiens
MNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTGGYAGGLSSAYGDLTDPGLSYSLGSSFGSGAGSSSFSRTSSSRAVVVKKIETRDGKLVSESSDVLPK

SEQ ID NO: 1031117 - protein, 240 aa, Homo sapiens
MKEEIRELQSQISDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 1031118 - protein, 279 aa, Homo sapiens; identical to SEQ ID NO: 1031116

SEQ ID NO: 1031119 - protein, 240 aa, Homo sapiens; identical to SEQ ID NO: 1031117

SEQ ID NO: 1031120 - protein, 277 aa, Homo sapiens
MKEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTRGKQGAELRLVGAKKPGSDKGGPSLGLGGPSLADNLRRGWKTNTVGTGWTRAAKERGGPDTPGPRRGAGGERPDPPERRTAHKVSRPK

SEQ ID NO: 1031121 - protein, 144 aa, Homo sapiens
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSMVLPAEDRLRTNMYYTLETE

SEQ ID NO: 1031122 - protein, 134 aa, Homo sapiens
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFHQHVAARTRMPGGLSWKACKAQKNSFGNM

SEQ ID NO: 1031123 - protein, 411 aa, Homo sapiens
PPLRARTHTHDAGRPTLACLLQQQKTARSNMDNMFESYINNLRRQLETLGQEKLKLEAELGNMQGLVAAHFTATHATERLHALTLTRYTHALRRNRTLAPSLTRTATAAHCTRLTTAHPTGYAALARLLAPCDTRPAPAPHALTPSLTRHPYLLTPRPHPGHPCPLPRTLAHPTLLAACSPRPPPRPPPLAPLAPPPPSACTAHPAPRYRTALLRPPRPPPRACPPAQPLLPTTSPLLHRTLAPTPCPCRPPPRALHPCRAAPPRTCDSPAALDPRHPFAPASRACRTGRAPPPRPHAPPLPRPALPHAPPPPPSWPPPACPPPLARTWPPPLPAPHPRLPRPPPYSPPPPTATPAPPPPNPPHPTPPPHPPPRPSPPPHYPPPPTPPPTPPAPRPPPPPPPPPHQPTHTS

SEQ ID NO: 1031124 - protein, 278 aa, Homo sapiens
MKEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTRGKQVGEAPAKGGPQSRAQSKGGPSLGLGGPSLADNLRRGWKTNTVGTGWTRAAKERGGPDTPGPRRGAGGERPDPPERRTAHKVSRPK

SEQ ID NO: 1031125 - protein, 261 aa, Homo sapiens; identical to SEQ ID NO: 1031114

SEQ ID NO: 1031126 - protein, 250 aa, Homo sapiens
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESPPWKVDPTKIKLPQGKLILKGDSGEACKSQGFSGKFCW

SEQ ID NO: 1031127 - protein, 249 aa, Homo sapiens
ARGQGRGQRHTNKVGGEETGTLSFSAPSRISAWFGPPASTPASTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFATQLAVDPKRTRWRRIGPSEGCENLMEQVS

SEQ ID NO: 1031128 - protein, 236 aa, Homo sapiens
MSIRVTQKSYKVSTSGPRAFSSRSYTSGPGSRISSSSFSRVGSSNFRGGLGGGYGGASGGEASSPSKTEQPKPTEPPKPEKKPAGRRRRAQEGGGRQGRKGGRVSRGTPRARGRRSASRGLGERESGRGEEGREEGGGRGVGGGGGGWGAGGGGWAEAEERGEREGGRGEGGRGWGEGGREGRGGDADGGEGGLRGAGARKRRRGGESAARRGARRGGGGAREGKTGGGGGARAGE

SEQ ID NO: 1031129 - protein, 483 aa, Homo sapiens; identical to SEQ ID NO: 1031108

SEQ ID NO: 1031130 - protein, 279 aa, Homo sapiens; identical to SEQ ID NO: 1031116

SEQ ID NO: 1031131 - protein, 279 aa, Homo sapiens; identical to SEQ ID NO: 1031116

SEQ ID NO: 1031132 - protein, 279 aa, Homo sapiens; identical to SEQ ID NO: 1031116

SEQ ID NO: 1031133 - protein, 124 aa, Homo sapiens [sequence omitted]

SEQ ID NO: 1031134 - protein, 120 aa, Homo sapiens
GRRLRSEPRPARPPIARAWPPAQGPMAERVALASLRRACLALPVTAFVPGPGARVRPGSAAAWSDGSSAEGRNQGARGQRSGRAPEPEQVAVRRGRARAAAADRAMEWAGLGLMGRCLAR

SEQ ID NO: 1031135 - protein, 384 aa, Homo sapiens
AAAASALSPAPLGRRLLGPGRQPRGRWPSASHSRPCAVPASRSLLRRSSPGLAPASGPAPRRPGPMAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 1031136 - protein, 494 aa, Homo sapiens
AAAASALSPAPLGRRLLGPGRQPRGRWPSASHSRPCAVPASRSLLRRSSPGLAPASGPAPRRPGPMAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGCFCFRMMFVGSKKLMDREPVKLLVRRLESGVLRGLTTRPRGERHMRFWKLRALLIVDSLVAVLSPALRKQVASPSSPRGPRTYTAWRRSTGAPVTPSPSPSAATPTMASRTQRSRSQQPGQGNFRRARVEAAAPVVHPPPRPPAPVAQSALGIL

SEQ ID NO: 1031137 - protein, 364 aa, Homo sapiens
QQRNERHQYYRYDPGLISRGSRSLLRRSSPGLAPASGPAPRRPGPMAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 1031138 - protein, 494 aa, Homo sapiens; identical to SEQ ID NO: 1031136

SEQ ID NO: 1031139 - protein, 381 aa, Homo sapiens
AAAASALSPAPLGRRLLGPGRQPRGRWPSASHSRPCAVPASRSLLRRSSPGLAPASGPAPRRPGPMAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGEGFGRPASASRSPACLPSPKSQSQQFCGKMKNSQSTRQAFS

SEQ ID NO: 1031140 - protein, 271 aa, Homo sapiens
CTAQSACTLESCGCVCLKFTFDLGVLASSGPDSLEGHAPVALETASHPGCPFTGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 1031141 - protein, 124 aa, Homo sapiens [sequence omitted]

SEQ ID NO: 1031142 - protein, 381 aa, Homo sapiens
AAAASALSPAPLGRRLLGPGRQPRGRWPSASHSRPCAVPASRSLLRRSSPGLAPASGPAPRRPGPMAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASIPRTWLCLPRCFRLFRRSVPGLWSPAVRGPVSAGGLVRMASSRLEGRKQGRPEGNGAVERRNLEQYQEGPSPAGRCTRLVGRGPVGYRTAGLEGWLCGSPHSLLWEQLGGRRTWVARGPGPRRGRRSRAREKHSRVARELEGVPTGHQKGTKALQDPAKMRPNSVNRRVGQPA

SEQ ID NO: 1031143 - protein, 384 aa, Homo sapiens; identical to SEQ ID NO: 1031135

SEQ ID NO: 1031144 - protein, 384 aa, Homo sapiens; identical to SEQ ID NO: 1031135

SEQ ID NO: 1031145 - protein, 384 aa, Homo sapiens; identical to SEQ ID NO: 1031135

SEQ ID NO: 1031146 - protein, 354 aa, Homo sapiens
MAWLACLMPDSRSLLRRSSPGLAPASGPAPRRPGPMAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 1031147 - protein, 494 aa, Homo sapiens; identical to SEQ ID NO: 1031136

SEQ ID NO: 1031148 - protein, 348 aa, Homo sapiens
AAAASALSPAPLGRRLLGPGRQPRGRWPSASHSRPCAVPASRSLLRRSSPGLAPASGPAPRRPGPMAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTMASRTQRSRSQQPGQGNFRRARVEAAAPVVHPPPRPPAPVAQSALGIL

SEQ ID NO: 1031149 - protein, 350 aa, Homo sapiens
AAAASALSPAPLGRRLLGPGRQPRGRWPSASHSRPCAVPASRSLLRRSSPGLAPASGPAPRRPGPMAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYRTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 1031150 - protein, 55 aa, Homo sapiens
MATSLSSPLPGRVSFFTSGSENLHRVEKVHWGTRYAITIAFSCNPDHGIEDPAFP

SEQ ID NO: 1031151 - protein, 308 aa, Homo sapiens
SGCAVRPAGVAGCLRTARGAPWRVSEVVSLLLVRNIAITGNLEVETPFCHPSVPRAAANPPAGLQDPGLTERPHRSRRPRARYAPGIMGEKSRRKGPAPRHADGKLGRTCDHPYAPWSFTPSSRAPTAWVRPPCPVWASRLQEHSPEPRRARAPPTRRAQAALYAPALRLRDHLDRFSILMTSCTSWLQAPQAPGLCRDEQSSRISVPQLSGAPILLPDLEGTKLSNFQESSPLPHKHERKDKRSTPEEEGRSAPEKIIQSLKLCPGGHRPASLSSGCPAGCRLSFNLPPSMLLSVQKCCMPSSLKTC

SEQ ID NO: 1031152 - protein, 308 aa, Homo sapiens; identical to SEQ ID NO: 1031151

SEQ ID NO: 1031153 - protein, 239 aa, Homo sapiens
SGCAVRPAGVAGCLRTARGAPWRVSEVVSLLLVRNIAITGNLEVETPFCHPSVPRAAANPPAGLQDPGLTERPHRSRRPRARYAPGIMGEKSRRKGPAPRHADGKLGRTCDHPYAPWSFTPSSRAPTAWVRPPCPVWASRLQEHSPEPRRARAPPTRRAQAALYAPALRLRDHLDRFSILMTSCTSWLQAPQAPGLCRDEQSSRISVPQLSGAPILLPDLEGTKLSNFQEKGSHSIVPG

SEQ ID NO: 1031154 - protein, 308 aa, Homo sapiens; identical to SEQ ID NO: 1031151

SEQ ID NO: 1031155 - protein, 442 aa, Homo sapiens
GDRWLRDPQSLGPAGFVFLWPQPELWLSFAPVADVIAEDLVLSMEQINWLSLVYLVVSTPFGVAAIWILDSVGLRAALGVYTIPAGVVCLLSTICLWESVPPTPPSAGAASSTSEKFLDGLKPLLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 1031156 - protein, 560 aa, Homo sapiens
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATCNMLATMSNPLGVLVANVLSPVLVKKGEDIPLMLGVYTIPAGVVCLLSTICLWESVPPTPPSAGAASSTSEKFLDGLKPLLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 1031157 - protein, 441 aa, Homo sapiens
MAGPTEAETGLAEPRALCAQRGHRTYARRWVFLLAISLLNCSNATINWLSLVYLVVSTPFGVAAIWILDSVGLRAALGVYTIPAGVVCLLSTICLWESVPPTPPSAGAASSTSEKFLDGLKPLLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 1031158 - protein, 463 aa, Homo sapiens
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAALGVYTIPAGVVCLLSTICLWESVPPTPPSAGAASSTSEKFLDGLKPLLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 1031159 - protein, 560 aa, Homo sapiens; identical to SEQ ID NO: 1031156

SEQ ID NO: 1031160 - protein, 560 aa, Homo sapiens; identical to SEQ ID NO: 1031156

SEQ ID NO: 1031161 - protein, 560 aa, Homo sapiens; identical to SEQ ID NO: 1031156

SEQ ID NO: 1031162 - protein, 494 aa, Homo sapiens
TQKNKMKKRGRNRTGKPGNGGTGGDPWRPPTMAGPTEAETGLAEPRALCAQRGHRTYARRWVFLLAISLLNCSNATLWLSFAPVADVIAEDLVLSMEQINWLSLVYLVVSTPFGVAAIWILDSVGLRAALGVYTIPAGVVCLLSTICLWESVPPTPPSAGAASSTSEKFLDGLKPLLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 1031163 - protein, 173 aa, Homo sapiens
MRLSGPGGHPLPSSWSSCWPCLLLPALMRLPRAPGLAHLKLLLGPPGQFRLRLPLPTRTGLGLPQGTGQLQSELWQPGSDSHPCPASPRKAPSLPRYLWPGLPPIHLSPNPGEALFSQGFCVQQGHLYTLLAGGLGTLELQEPEEGALFLDLHNAAVGDCSWSPGFCQAHSVC

SEQ ID NO: 1031164 - protein, 454 aa, Homo sapiens [sequence omitted]

SEQ ID NO: 1031165 - protein, 399 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 1031166 - protein, 318 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREALKSRGPRGRATQYCAIDRKMWPGVATGQVIPPNCDRVAHKRRAKTTDYVKPPKHTETGRNGRSTAAITTV

SEQ ID NO: 1031167 - protein, 133 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKVRISFCCPGWSAVA

SEQ ID NO: 1031168 - protein, 436 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKVKDLILLPRLECSGMIMAHCSLKLLGSSNPPASASRVGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 1031169 - protein, 162 aa, Homo sapiens
MYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 1031170 - protein, 327 aa, Homo sapiens
MPGPPDAFLTAEFMCEIRKVRVVLLSQRPACEAQGTHLPSPVLLCLQGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 1031171 - protein, 399 aa, Homo sapiens; identical to SEQ ID NO: 1031165

SEQ ID NO: 1031172 - protein, 187 aa, Homo sapiens
MGLQLRALLGAFGRWTLRLGPRPSCSPRMAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKVGGGLLCPSPAAMSSTWPTFQLSVLACYAVSEHIMMYKSN

SEQ ID NO: 1031173 - protein, 159 aa, Homo sapiens
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKVGGGLLCPSPAAMSSTWPTFQLSVLACYAVSEHIMMYKSN

SEQ ID NO: 1031174 - protein, 399 aa, Homo sapiens; identical to SEQ ID NO: 1031165

SEQ ID NO: 1031175 - protein, 368 aa, Homo sapiens
VIFPVMYKESNRAISIIYPSLQACIISLCWRHSVSSHYWKITINGCKFSHLIEHCTCPSCPSSSCACSPACGCPLPREADACWSLVGALGKETLGLTPCSGCSLVIQALLYLPFSSLTTSPLGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 1031176 - protein, 399 aa, Homo sapiens; identical to SEQ ID NO: 1031165

SEQ ID NO: 1031177 - protein, 189 aa, Homo sapiens
MGLQLRALLGAFGRWTLRLGPRPSCSPRMAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGAQSPGRQ

SEQ ID NO: 1031178 - protein, 399 aa, Homo sapiens; identical to SEQ ID NO: 1031165

SEQ ID NO: 1031179 - protein, 687 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAV

SEQ ID NO: 1031180 - protein, 526 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKAMDGINSSRSHLLLLGNRI

SEQ ID NO: 1031181 - protein, 602 aa, Homo sapiens
MAADKPAQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAV

SEQ ID NO: 1031182 - protein, 226 aa, Homo sapiens
MKAQSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCREEIIALNAHRRKQERSKIDTLTSQLKELEKQEQTHSKASRRQEITKIRAELKEIETQKTLQKISESRSWFLERINKTDRPLARLIKKKREKNQIDTIKNDKGDITTDP

SEQ ID NO: 1031183 - protein, 179 aa, Homo sapiens
EVKRCQEAQNGPESDVWTHQSKIRCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAV

SEQ ID NO: 1031184 - protein, 614 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQG

SEQ ID NO: 1031185 - protein, 627 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESCK

SEQ ID NO: 1031186 - protein, 652 aa, Homo sapiens
MKAQSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAV

SEQ ID NO: 1031187 - protein, 400 aa, Homo sapiens
RLGSEAGCRNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAV

SEQ ID NO: 1031188 - protein, 126 aa, Homo sapiens
GLASHLVAAWPPTWLRPGLPLGCGLASHLVAAWPPTWLRPPTWLCSILACSAYVALALGDNLMALNHADKLLQQPKLSGSLKFLGHLYAAEALISLDRISDAITHLNPENVTDVSLGISSNEQDQG

SEQ ID NO: 1031189 - protein, 660 aa, Homo sapiens
MAADKPADQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCRCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAV

SEQ ID NO: 1031190 - protein, 711 aa, Homo sapiens
MGERSYTLSIGNGDYFGQIKKMLWDYVQTLSDQGAEKHEGTGQSSGITDQEKELSTNAFQAFTSGNYDACLQHLACLQDINKDDYKIILNTAVAEFFKSNQTTTDNLRQTLNQLKNQVHSAVEEMDGLDDVENSMLYYNQAVILYHLRQYTEAISVGEKLYQFIEPFEEKFAQAVCFLLVDLYILTYQAEKALHLLAVLEKMISQGNNNKNGKNETGNNNNKDGSNHKAESGALIEAAKSKIHQYKVRAYIQMKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAV

SEQ ID NO: 1031191 - protein, 459 aa, Homo sapiens
MKSLKACKREIKSVMNTAGNSAPSLFLKSNFEYLRGNYRKAVKLLNSSNIAEHPGFMKTGECLRCMFWNNLGCIHFAMSKHNLGIFYFKKALQENDNVCAQLSAGSTDPGKKFSGRPMCTLLTNKRYELLYNCGIQLLHIGRPLAAFECLIEAVQVYHANPRLWLRLAECCIAANKGTSEQETKGLPSKKGIVQSIVGQGYHRKIVLASQSIQNTVYNDGQSSAIPVASMEFAAICLRNALLLLPEEQQDPKQENGAKNSNQLGGNTESSESSETCSSKSHDGDKFIPAPPSSPLRKQELENLKCSILACSAYVALALGDNLMALNHADKLLQQPKLSGSLKFLGHLYAAEALISLDRISDAITHLNPENVTDVSLGISSNEQDQGSDKGENEAMESSGKRAPQCYPSSVNSARTVMLFNLGSAYCLRSEYDKARKCLHQAASMIHPKEVPPEAILLAV

SEQ ID NO: 1031192 - protein, 115 aa, Homo sapiens
PNIFSNVQFILKASEIIGKRELRSESIFRPVEDKKRYENTDSDMGGYEINHLLWHCVAAWSCVQNNSPQLNNVLEHLVFHKTQLQKKCWLGFSTGFTGPWGRLAKIKTWACLESF

SEQ ID NO: 1031193 - protein, 254 aa, Homo sapiens [sequence omitted]

SEQ ID NO: 1031194 - protein, 384 aa, Homo sapiens [sequence omitted]

SEQ ID NO: 1031195 - protein, 384 aa, Homo sapiens
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 1031196 - protein, 384 aa, Homo sapiens; identical to SEQ ID NO: 1031195

SEQ ID NO: 1031197 - protein, 254 aa, Homo sapiens [sequence omitted]

SEQ ID NO: 1031198 - protein, 1320 aa, Homo sapiens
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARGAVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR
